United States Patent 10,724,096 (METHODS AND COMPOSITIONS FOR INHIBITING AND TREATING NEUROLOGICAL CONDITIONS) - sequence listing, part 34

SEQ ID NO: 583 - DNA, 915936 bp, Homo sapiens
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgcttgtttgtccttctaacaagaccatgagcaattggaggacaaggattgtgccttactcatcacagtatctctagtgtttagcataatgcttgacacacaggagtgatcaatagttatctattgagtgactgaattaatttctccaattgattctgcttagacaggcctttctcctacattcccccaaatgcaacctgctaattcacatttctctatcctggtttatgttatttctctcaactggagtgctctttccttcttttctccacttatataagtccacctagttcttcctggtacaactagttgctacatgagtcctgttctaactattccagatctcatagagtcatgtcctcctcatgccttgactcttttagcctatgggatgccccacacactttagccctttattatgtgcagctttatattatttgccaatttaaaaaatatttttgtcttgttttcccaaccattatgaaaagtagccatgtgttgtatcattttctctccccttcatagtgacttaagtgtggaagagaccgttggataacaaactatggcctataagccaaatccagtccaaaacctaagaatatttcttttttaaaaaattaattaattaattaatttatttttgagacagagtcttgctgtgtcgcccaggctggagtgcaatggcgtaatctctgctcactgcaacctccgccccctggactcaagtgattctcctgcctcagcctcctgagtagctgggattacagacgcccgccaccatgccctgctaactttttgcatttttagtagagacggggtttcaccgtgttggtcaggcttggtcttgaactcctgacctcgtgatctgcccgccttggcctcccaaagtgctggcattataggtgtgagccaccacgcccagcaagaatatttcttatgattttaaatggtaagaaaacaatcacaagggctgggtgtagtggctcacgcctgtaatcccaacattttgggaggccgaggtaggtggatcacttgaggtcaggagttcgagaccagcctggccaacatggtgaaacctgtctgtactaaaaatacaaaaattagccaggcgtggtaccaggttcctgtagtcccagctactcaggaggctgaggcaggaaaatcacttgaacccaggagacagaggttgcagtgagcagagatcatgccactgcactctagcctaggcggcaaagggagactgtctcaaaaaccacaagaaaaacaatattttgtgacatgaaaattatatgaaattcaactctccataaataaagttttttgcaacattgccacgtttattcatttacacattatttatgcctgcttttgggctacagcagtagagttgagcaattgtgacagagactctgtggcccacaaagcctaaaatatttactatctgaccctttacagggaaagtttgccgactgctggagtagatcatcaatgagtacttactggttaaataattcattgtcttatgactctattctattatgaaacaagatagtctgaaagtactgttaattatgctgtcttgccttacataaagaaaaatagtaataaaagcaacctctggagaacagattatttttatcttttagttggtgaagtataaaaattttcattttctcattctctggtaaagtgacttatagtgcccttattagttttaaaccttttcaaatatgcagaacctcttcctgcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagttgcatctataagtcattttgggaaatattgtagggcttaccaaattgatcacaaaatagcattaatattgtaaacctgaagtgaacaacataaccagttttttaaaaataaggcactctacttgagtcatcaggaaaacattagaaatctacctatgtgcatcatattatatgtaaaatttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacacacacacatcctttttatggcctcgtgcagtggctcacccctgtaatcccagcactttgggaggccatggtgggcggatcacctgaggtcaggagttcaagactagcctggccaacatggtgaaaccccatctctactaataatacaaaaatcggccaggcatggtaactggcctctgtaatcccatctacttgggaggctgaggcagggagaattgcttaaacctgggaggtggaggttgcagtgagcagagatcgtgcaactgcactccagcctgggcaacagagtgagactctctcaaaaaatatatataggccgtgtgctgtggctcacacctgtaatcccggcactatgggaggccaaggtgggtggatcacctgaggtcaggagttcgagaccagcctgaccaacatggtgaaacccgtctgtactaaaaatacaaaaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaagaaatataattatgtaaagaatattttgaatgaaattttgaataaattggtagaaacatagttaattgttcgctgcatcccaaaacagtaggcttggaaagtgatgcttttctactttaattttaaatcttgtacattttataagaaaggagtaagcctatccccatattaggcaagtcagattaaatgttagttccattaattcagagaaaataagctcagttaatgatgattcaatgccagttgaaaaataaacagatatgcaaaatcttggtttcttcctgtaatttcttaccatttttttcagtttctttgttgttctgttaaatctttagttaggttatggtagaatgccgtggtacctcattgttctttaactctagtgattggttgtttttaattacattaatggtagttttttgttttttttgtttgttaattttttggtatatcaaacattttctgttaaaggagaaaggaaagaagagctttgacttacaaactgacttgaaagctattccagcaattggttgtctttgaagtaggcaatttaccctttttttcccttcaaaatcagttatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacagaagatgtggacactggcctaggaaaagtccccaaagaatacataaagctctggactggaacagtcatagcttgcaactaccgtaggacatctactttcagcctaggatgtcttcatattttataaaatataaatctagatagtaatagaacattaagatctttggagcaactcaccattccttacgagatcaggaccgatcttatacaaaccctgatcagctgaattaggatcacatttgttataattattaccgatcccttgagagccacctttgacccagcatatcatacccacaagcctaagagtaagctgcagaaagactgtttcttagaatggttgtccattattgactaccctcttctaccttatgcatgtttcttttgtccttttttcgttaaccatttataaagttagatgctaaagaatattgagctcagaaatagtatttccaaataaacaatgtgtaaatcaatttaagctgtttacttccccattgggaataatctctcttactttctacctatgaaaacttcacccaggctttcaccatgcatagctcagatcccatctacctcatcaaggcttcgttgaattccccatttgaaagtaatctgcttgctgtaattacataacttatactctctatgtagttctgttgacacttagcaaaaagtaccctatattatagttttgtttttacatctctgtgttttattgttaaagaaaaaattattctgacacttgttaaatatggtaaggctgacttcattcagagggactactacagtggaattttgtagtacggtagtgagattaagccaaactccacacacaagaagtaccaagtggacatttatagccatgaaccagggtgggggtcgattgatggaaaattactaagaggaaacatcaggcctaagggcattccagctaaactgacttgacaggattcttgctgaagtcagaccaagatgataagatatccagagtgaggaataaggaatttgatcagataatcaagggtgagggatctgcactaaactaacccagtagtatttttgctaaaacaggactaaatgagccagggacagagcctaagtttgggtctagttaaaaagggagctcagaagaatctgactcaagtttggtcaaaggagagagtctgtcattatctcctcaatgagattctagagaataggaattataattcatactcttttgtatctctactccctactgcccccacccccatgaaaaacagtgtatgcatgtcataaagtagtttgtaattgagtatttttcattgatggttgactaattttgacagagccgacaccttaattcaccagttaaattggctctaggcacagccttgcacaactcatcattatttgactaaatgaagacaatatattctaagactctggtacagaatttctggttaacagtggttggcataatttattctcttgcctgccattttcaagtgatgttactgctttgaactcattttttaaagtaatatttataaatataactggtaaaagtgtggcatctttggccaatgaaaagaattgctgtcagcttgagaaaagaaacgtaaagcactaagtatactagaaattgcagacatcctcacaaaagtgatggattaatgaccacatacagcattatgaaagctagttatggtttgcttaaaccagtctctctctttatggcattctcaatctttttaaacagctaggatataataacattttaaaaattaaagtatttcacataaccaagaacttgatatgaaatgagcaacattaagcacaaaacaattgaagcttcaaatactggagcaggcaagaattttaaacagcccgaatgaataaggatgcaacattgttgtgcttcttcagatgcaggaataatcaggctcagaggttagcagaaagagattttatagcaataatggctccccataccatttttctcttgtgactttgactcacaaaggtgaagctttcatttgaagatttgatacaatgcagctgccaacagcaggggggagaatttggccaaatggctggactctctcaaacatctgtgagggacagagattgagagggagagacagggagaaattgagagagatataaaaggaaaagaggaggggaccaaaaagaaaaaaaaaaaaaaagatttgcattaccaatgacaaatcaaagttgaaagtttgcctttcctgttgtcattcattgccattcatatttagaaagcagactgctgtgataattgatttgatggtccagcttgagtggaagcacttctgggcatagcagcctcagagatgccaaaaaagaagaaaaggtgggaatgaaataatgcactactttctcctcagaggcatgtggcccagtttttaagagcagaaaaacatgctctggggtggggggagtagaaacctaaagaacttagtaataaatacaaaaatgaccatatagctccagtcagataaaaataggcattcaaaccaagacaatgagaggacatattttactgacaagtgaataataggggagtgtggtggaaataatctgatttttaacagactctgtcctttgggagtaccttttttgctcttcttttatatagagacaaaagtgatttcttttctaaaaagccttttaatttttaagcttttcatactagattgatagttcagaaggagaaaaagaaaacaataattgagactgaaaagctatatatgtgcccggattatgtaaacatcactgaatttccttgaagcaataggtaataatgaagcttgtccttagatttgtgagtagaggttggtgttcagccattgcttcctgctgatatgaataagttaggaaactaaagtgccagttgaagggggcaaaagagagagagagagaaagagttttttaaagtactgaattcactgcctgacctcttaatcacaactgccaattggattgtatgccctgtcattccatttaagaacctaaacaaaccagataaaagacatagctgtcaaaacacaaattttaatcagaacctgtttgtcttttgagagaaatatacttgtgttcaaaagtagatcagtcctttaactttgttacctttctctcttttcttccctctcccttctatcttcagttctcctttcttcatttacgtacctagctagctgcctctacttatacctacagagaaagcctgttgtttggcctcattgaatgtgtcatacatatgcagctgttatgcaaatatcaataccgtcccatcacaatttctgttttcctggtaaggttctcaactacagtgagacattaaattttctgagttaaaacaacaacagcaacaaccaaaaccctcaaatgtatgacttatttttaaaagattcatccaaaattaatatggaggaaacagtgttagctgtcagtataatgtatgacagtatttctgaaaatcttttaaaaaaatcatgagaattacctgggaaacttactaaaattcattatacaatgtatacctatatcaaaacatcacgttgtaccccataaatatatatagttattatatatcaatcataaattgtttaaaaatttagagtatcagaccataccccaggtcttgaatcacagtatatagtgctcaggaatctacattttaacaagtgcccagatcatttttctacatactactgaagtttgaataccagagacataatagttaaagagcaatatttaattacatcaactggaatctaattccgtttttaccattactagttgtgtaaacttaggcaaattatctagcctttctaaaacttagtttcttcatccatgaaatgtatgtaacaatgcctacctaatagggttattctgagaattaaataacataacgaatataaaacacagcacagtagctggtgattctaatatcaatacatagtcaatattattgatattgtttatcttttatgatttagaaataggttcttttctatgggttgttcatattgcgcccttgtaaataatagtttctatttccattttatattaacatagacggtacttttccatgtctcaaggatgtataagattaaacatcaggccaggtgtggtggctcatgcctgtaatcccagcactttgggaggccgaggcgggcagatcacgatgtcaggagatcgagaccatcctggctaacacggtgaaaccccatctctactaaaaatacaaaaattagccaggcgtggtggcacgtgcctgtagtcccagctactcaggaggctgaggcaggagaatcacttgaacctgggaggcggaggttgcggtgagcgatatcacgccactgcactccagcctggtgacagagcgagaaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttactctagaccaaaagagtaacatttgtttttgatacacccttctttgtgccagtgttctctaagtactttttggattctcgtgctagagaaaaagagctataagaaatgaaagataaacctaacctagggttttatctgttaccagaacagtatatatgttacaaatgacttataaaattacccaggcagtgggagcacttcctagccatttcctggtgtgctacctgtggccattctaagcattgactaaaaattattcacagaccttgattttattgctagtgatatatttacacatactatttagcccagattattcatatactacatatatgcctactagcccagtgcaagtaggtagtcacttgtttacctctcagaaacagcaagctgttatttttcctttttaaaaatttggctatatttgttttttggttgtaggaagaaaacttaacaagagatctaccctcttatcaaatctttaagtgcacaatacaatattgttaactataggcactatgccatacaatagatctctagaatttattcatcttgcacaaatgaaactttatacctgttgaacagcaactccccactcctccttctccccagaccctggcaaccaccattctactctgtttctgtgagtttaactattttaaatagctcataaacgtggaatcccgcagtatgagtctttgtgtgcctgtcttacttcacttagcatatgtctccaggttcaaccatgttgtcacatatggcaggatttctttctgtgtttaaggctgaatcatattccattgtacgtacataccacattttctccatttactctattcattcactgatggacatttggattatttccctatcttggctgttgtgaataatgctgcagtgaacatgggagtgcagatatcaatttgagatcctgctgtcaattcttttttttgttttttttgttttgagacagagtctcgctctgtcacccatgctggagtgcagtggcgtgatctcggttcactgtaacctccacctcctgagttcaagcaattctcctgcctcagcctcctgagtagctgggattacaggcacgtgccaccacgcccggctcattttttgtatctttagtagagacggggtttcaccatgttagccaggatggtcttgatctcctgacctcgtgatccgcctgccttgacctcccaaagttttgggattacaggcatgagccaccgcgcccggcctcaattctttcggacatatccccagaagagggattactggatcttctggtaagtctgtttttaattttttgaggaagcttcatactcttttccataatggctgcatcattttacattcccactaacagttgtataagggttccaatttcttcacatccttaacagtgcttgttaccttttcacatccttaacaatgccttttacattttttttttgttgttaaatagtagacatcctaactggggtgaggtgacatctcattgtagtttttgatttgcatttccttgattagtgatgttgagcatcttttcacatacctgttggccatttgtatgtctactttggagaaatgtctattcaaaacctttccttattttttaaactggctatttgggagcttttttgttttttattttgttttgtttcattttgtttttgagatggcgtttcgcccttgttacccaagctggagtgcaatggcacaatcttggctcaccacaacctccacctcccgggttcaagcgattcttctgcctcagcctcccgagtagctgggattacaggcctgcaccaccatgcctagttaattttgtatttttattagagatggggtttctccatgttggtcaggctggtcttgaactcccaacctcaggtgatctgcctgcctcggcctcccaaagtgctgaaattacaggcatgagccaccatacccagctgttttgtttttttgatcttgagttatttgagttccttacgtatttgacacattttgcatagttagccctttatcagatatgcagctagcaaatattttctctcatttttgtaaattgccttttcattttgattgcttgctgtacagaagctttttagttttatgtaatctcactgtgtttttgcttttgctgcttatgcttttggtgtcatatccaagaaatcattgcccagaccaataccatgatgcttttcccctttgttttcttcaaggagttttgtaggtttaggtcttacgtttaaatctttaacccatttttagttgatttttatatataatgtgggatgaaggtccaatttcattcttttgcatgtccatatccaattttcccactaccatttgttgaagagactttccttttctcattctgtgttcttggcaccccatacaaagatcagttgaccatatatgcatggatatatttctaggctctctattctgtttccttggtctacatgtctgtttttatgtcagtcccatattttttaaattgctgaaggtttgtaatatattttaaaataaggaagtgtggcgaatccagctatgttcttctttctcaagatttctttggctattcatgctcttttgtagttatgaattttacgatgggtttttctatttctctgaaaaatgccattgggacatttaaagggattgcattgaatctatagattatcttaagtagtatggacattttaacaatattaagtctttcactgaatatcttttcatttatatatgttgtctttaatttgtttcatcaacgttatgtagttttcgccgtacaagtctttcacctccttggttaaatgtattcctaagtatttcattctttgtgatactatgcaaatgggattgctttctcagttttgttttcagtactttattgttaatgtacagaaatgcaattgatttttgtatgttgattttgtatcgtgcaactttgctgaattttttaattagttttaacagttttttgtggaatatttagggttttctctatgtaagatcacgtgtcggcaaacagagatagttttacttcttttttttttcctcccaattttaatgtcttttatttttctttttcttgtctagttgctccagctagagcttccagtactatcttgaatataaatggtgagggtgggcattctttccatttcctgatatgagaagaaaaactttgtgttttatcattagtttgatattagcagtgggcttttcatatatggccttaattgtgttgaggtaaattccttgtatgtctaatttattgatagtgtttatcatggaaaggtgttgaattttttcaaatgctttttctgcatctattgggatgattgtgtgatttttatccttcattctattaatgtggtgtagcacattaattgatttgcatatgttcaagccatcctcacatattagggataagtcccatttgatcatgatgtatgattttttagaacttagtgttgaattcggtttgctaatattttcttgggaattttcacatctgttttcatcgaagatactggtctgtagttttcttgtagtgtctgtgactttgtattagggtaatactggcttgattgaatgagtttcgaagtctactctcttaaagtctttaaaaagtgttggggttaattcttcattaaatatttgataaaattcaccactgacaccatctaatgctggatttttctttttgcagagggttttgattactgattcagtctccttgtttgttattggtctgtttagattttccatttcatcatgatttacccttggtaggttgtatatttctgtgaatataaccattgcttcgagattatccaatttgttggtgtataattcttcatagtagtctcttctgatcctgtttatttctgtggcatcagttctaatgtctcatctttcatttctgattttgaatcttttttttttttttagtataaggatttttccattttgtttatattttcagaaaaaaacaattttctgtttcactgattttttttctactgcttttctgttctctatttcatttattttgactctagtctttgttatttccttgcttctgctaatgttgggcttctcctaaatttgttctttttctggctccttgaggtataacattagattgtttatttgagatctttctacttttttaatgtaggcattttatcaccataaatatccctcttagaattgcttttgctctatctcgtaagttttgttatgttgtattttcatttttgcatgtcttaagatattttctaattttttttttaatttcttcattggcccattggtttttaaagagtgtgttgtttcatttccacatatttgtaaattatccaattttccttctgctattaatttctagtttcattccactatagtcagaaaagatactgtgtaggatttcagtcttaaattcgttgagactttttttgtgacttaacacgtgatatattctggagaatgttccatgtgtgcatgagaagaatgtgtatttcacaactgttggttgaaatgtcttctgtatgtcttttagttcctcttgctcttagtgttgttcaagtctattgtttccttattgatttttttttttgcctggatgttctattcattatcaaaagtgggatatgaattatcttaccaataccatagtgctgtctgtttcctacttcagatctgtcagtgtttactttgtatatttagatgctctaatatttggtgtatatatggatttataattgttatatcttcctgatgaattgctttcattattatgtaatgacctttttcgcctctatgtcggtttttgacttatagtctattttgtgtcacataaagtatagccactcctgctctcttttggttaccatttgtgtggaatatctttttctgtctctttactttcaggctatgtgtgtcctcaaagctaagtgttgtctcttataggtagcatataattagatattgtttatttatctattctgccactctgtgtcttttgtttggggagtttaatccatttgcatttatttatttattttattttttttgagacagagtcttgttctgttgcccaggctggagtgcagtggtgcgatctcggctcatggcagcctccgcctcctgggttcaagtgattctcctgtctcagcctcccaagtagctgggactacaggcgtgcaccaccacacccggctaatttttgtatttttagtacagacagggtttcaccatgttgcccaggatggtctcgatctcctgacctcatgatccacccaaagtgctgggattacaggcgtgagccaccgcaccaggcctccatttacatttcaagtaattattgatagggaaggacttactattgcccttttgttgattgttttctgtttcatagtctttttgtccctgttttcctctcttgctatcttcttttgtgatttgttgattttttgtagtgatatgctttggttccttcttctatttcttttgtgtatcttctatagttaatttctttatgattaccatgaagcttgcatagattgtcttacagttacagcagttctatattaagctgctgacaacttaactgcactcacatacaaaaaccttccacttttacttctccctcaccatactctgttattgatgtcatagtttaaatctttttatattgtgtatccattaacaaatttgtgtagttataatcttaatatttttgtcttttaactttaatagtagagtttaaagttatttacagtccaccattattgtagtatccgggctgggcacagtggcttctaatcccagcacttcaggaggccaaagtgggcaaattcattgagtctaggaattcaagaccagcctgggcaacatggcaaaaccctgtctctattaaaaatgcaaaaaattagccaggcatggtggtgcacaattatattcccagcttctcaggaagctgaggtgggagaatcagccgaggctgcagtgagctgtgatcatgccactgcagtctagcctaggcaataggaatgagaccctgtctcaaaaaaaattatctatgtctatatctatattatatatatatagtattctgtgtttgtctgtatgcttgcccataccagtgtgttgtattctttcatatgcttttgtgttactgttttagcatctgttcatttctactggaagaactcccgttagcatcatgtctagtggtgatgaactcccgtgccttttgtttggaaaagtctttatctcaccttcacttttgaaggacaattttgccagatatagtattcttgattggcatttttttttctttcaacactttgaatattataagctcactgccttctggtctgcaaggtttctgctaagaaatccactgatagtcttattgaggactcactttacatcacgagtcacttttctcttgctcctttaaaatttttctttgactttgtgcaatttgattatattgtatctcagtgtagacttctttgggtttgtctaatttggcattctttgggcttcatgaatctggatatccatttccttgcccagatttgaaatgttttcctccatgagttctttatataagctttttcccctgactatctctcttctcctttgagattcccataatgaatgtattggtctgcttgatgatgttcagtaagtagcttaggctttcttcattctttatcattctttgctttttgctcctctggctacataatttggatgacttgtcttcagtttcactgattccttctgcttaatcaagtctgctgtttaatcactgtagtgatttttcagttcagtcactgaaccagaatttctgtttggttatttttatttatttatttatttatttattcatttatttattcatttatttattgagacggagtttcactcttgttgcccaggctggagtgcaatggcacaatctcggctcactgcaacctctgcctcccgggttcaagctattctcctgcctcagcctcctgagtagctgggattacaggcatgcgccaccatgcctggctaattttttatttttagtagagacggggtttctccatgttagtcaggctggtctcaaactcccaacctcaggtgatctgcctgcctcagcctcccaaactgctgggattacaggcgtgagccaccgcacccggcctggttatttttttttaaataatttctacctctgttagggccagatgtggtggctcatgtctgtaatccagcactttgggaggccaaggcaggtggatcacttgaggtcaggagatcgagaccagcctggccaacgtgatgagacaccatctctactaaaaaaaaaaattacaaaaattagccagttgtggttgcacatacctgtaatcccagctactggggaggctgaggcaggagaatctcttgagcctgggaggcaaaggttgcaatgagcccgagattgtgccactgcactctagtctgggtgacagagtgggactccatctcaaaaaaaaagaaaaaggcaactcaaacaacaacaaaaaaaccagcctgagctgggcatggtggctcacacctgtaatcccagcactttgggagtctgagatgcgtgaatcacttgaggtcaggagtttgagaccagcctggccaacatagggaaaccccatctctacttgaaaaacatatttatatatatgtatgtatatatttgtgtgtatatatatatatttatatatatgtatatatttgtgtgtgtgtatatatgtatacacacacacacacagaaaaattagccgggcatggtgtcccatgtctgtagtcccagctactcgggatgctgaggcaggagaatctctttaaccagggaggcggaggttgcagtgagctgagattgtgctgctgcacttcagcctgggcaacagagcgagactctgtctcaataaataaataaatacatacataatttctacctctgttgacattctcattttgttgctgaattattttcttaatgttgttcagttgtctatattctcttgtaactcactgagcttccttaagatgattattttgaaatctttgttagcctattcatagatctccatttctttagagttgtgtattacgatttaatttgttcctttagtgtaatgtttcactgatttttcttgtttcttatacttttgcactggtgtctgcacatttgaggaagcagccacccttcccattctttctggacttgtttagacatggaaagagcttaaccaattcactaggctagagattctaggagcctctcaaaccttttctatgaatgtgtcttctctggatttgtgtgggaggattcctaattagatggatttacccctagcacaattcatagagccatgctaatgtcttctgaggcaggacagaatccagcccgaccctggtggttcactgaggccagattgttgggaacatgttccatttctctcctatcacagtggaagaagcatcaggctctgtgccttctctcaatcttgtagagctatgctcaccacagtaagctgcctgccctttttcctttgttcttaattgccctgaaacatccaagctatttcttttctatcagtgtcccatgtgaggtgagatagaaactagcccttcaggcagtgcaccaaaaggctggtacattggaagcattctctactctgtattttcccctgagaaagaaactgtgggccaaagtgatatttttcagtgctgagctgtgatggcttgggggaaggggctaatactagtaaagtgaaattgctccttactcatttcagtagagttttttcagttttgtgtttctctggtgtactgcaacctcttaaaaggattctggtcttctcataaaggtattgtggtctacattgttaagttggtgtttctatgggagaacaagagatggaactttctatttcaccattttgatgatatcagcaagctattatttaaatgagaagtttcctttacttagatgagcaatataatttaatgcaagtttgtctatggatttctccttgagtgactacattacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtaccttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatgatgaaaccccatctctactaagaatacaaaaattagcgaggtatattggcacatggctttaatcccagctacttgggaggctgcagcaggagaattgcttgaacccgggagttggaggttgcagtgagccaatatcatgccactggtatattggaagcattctctactctgtcttttcccctaagaaagaaattgcgggccaaagtgtgtaagggaagggttaaaatgagtgagtgagtctctctctctatatgtatatatatatcatataacagtctttttctaattccaaggaatagaggcatgctaaagtttttaaaggtaatatagggttaagaaaatatgaggaagaaatatcacagtggtctcccagccatggctcatcaaaactagaatgttctgactacaacagtggctctggaagtctgacagcacctctgacatattgaccaccctgctggtagtcttcctttaggagcaggtttgtgcttgattccagttgtaacttactaatccttctattcttatgatttgccattatggtgtctcagctactgcatttttatttttctgtctatctaattcttcttttatttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacattaactatatctctggatgtagggtcattttataaaccaaatgctgtattttgtccatgaggcacctaaaatagcacagccagggatagctaagcttacagttgtgatacattaatgaataacctctggttgttgactccctttttgttattgggagagttaatgtagcttttttcaaatttttagattcagcgggtacatgtgcaggtttgttgcataggtatattgaatggtgagatttgggcttctagtgtacttgtcactcaaatagtgaccattgtacttaatagatttggagatttctcagagaactaaaaatagacctaccattcagccctgcagtcccactattgggcatctacccaaagggaaagaaatcattctatgaaaaagacacctgtactcatatgtttattgcagtactactcacaatagcaaagtcatggaatcaacctaaatatccatcaacagttgattggataaagaaaatatggtatatgtacaccatggaatactatgcagccataaaaaagataactttaattataattatgaatcaacatgtctttctttccatttctactatgtaaatagagcagaaatcccacattaatgtgattagcatagaagaaagtcctcactgaattccccttgctctcttaccaactggctggacatggcataggtggttatctaagaatactcccatgaatcttcacagcattcagagatcagtttactctgggtttgttagatatgcgatatgggctagctgtttgttagaaccacatttcccaatgtgtttccactgaacacttattttttctgatgttgctacatgtcttgtgtaaaaagcattgggtaaaagtgctgggtaagttaaagggctctgataactctatataatgtatgtagatttctggctgaatctttgggtgtttactgctcatgggttccactgctattacagcccaacacagctggtatgatttgcaggttggtctcttggggccctttcaccttctgagctctgaaagcctaagataagcaatttttcctttgtccttcaagatgactgtggtctcagcttagactcaagagaactcgtttgaaattgaacaagagcaagcctagctcaagaggatagcaaagtgcctagttttatttgtcactgcactagaaacttcctaaggaataatttttaaaagggggccagttttgtttctgagactcaactagactttcactcatgctctgggggaaggaattcaagtctccaacattgtccttattgtacacctgtagggccagactgattatcctaaattttacatagcctaagaatgagcttagatttcaaaataaaaagctttctctgcttttgcgtagaacatttctatctattatttcagttaatttatccttgttatcaatattgaagtaccgcttgctatacatattctagacatgggtaacaatgtctagaagtacactctgatttcacaacagccattcaaggagatatatatatatatatatatatatatatatatatatatatccttgcaagtgcattctagggctgctgggacatgtgttcttaaatcctcctttgccagttctccaaatatgccaaattgttttgaaatggcattcttgtcttgtcttgttgaatctacacttctattccttccttttgctttttattccaaccttccattttctatcctttaattaaaaagatggctaatatatgggagatgttgtagtccgttgttgtctaaaatgaatttagcagacactcccccaccattccccctccccaagttcagcatcaggaataaaagtctcatcagtccttttggcagcatttaagtgaatggcccccagtggctttatgcttgctaatttgagtactctttttacgtacagagctagtcagattgacagaccacactgtacgaagatatatactagtctttgagtcatagattttgtaaataaactgagaacagtggctgaaaatcagattacctgaaagtctggaaggaaaaaggcatagaatgacctcatctagtctcttttcaaaagcactatatatatttcaaattttagagtttctagagacaattagcaggcagtagttgcaagaataggcagaacccctgtgagatgtataagctgtatgatcttcattaacttatatctaaaagtttaacaaacatatactgacattatttttaaaagacaagtatgttaaggaatttgtcttctacatagtgacaggtatcaaagtgaagaatatggccttttgtttttttcttactatatactaaaatgttgctttatattaaaagatcgtaatttatttccatgaatcaaattctgtacttaaaactgacttctgtttatttatatactgttgtgtgatagaaattctcttgggggaggcaatagaaatattacatgccttttaataaagcgggcttttaaaataatttaattcaacttttcacctcttatgaaatttttgaaaagatattttctaatttattttattttattattttttatttttgagacagagtctcactctgttgcccaggctggagtgcagcatcgtgatctcggctcactgcaacttccgcctcctgggttcaagcaattctcctgcctcagcctcccgagtagctgggattactggcatccaccaccaagcccaactaatttttgtctctttagtagagacagggtttcgccatgttggccaggctggtcccaaactcctgacctcaggtgatccacccaccttggcctcccaaagtgctgggattacaagcgtgagccatcgtgtccagccttatttttttttattttaaatagagctctccaaataatgtctgttttgtattgaaatgaatgaattcatgaacttgctttcttcgcagcatgagggactaacagctagaataaaaataatcaacctaatatttcttgttgctggaaaataattatgagaatattacacagaggaagccatgcttaaaataaaggcttcatattgcatttaaaactcaggcgggactttcaaggattctgtttagtagaataatatattgatgaacccttggagaaccaattatgttgtttcacatgaattacaaatgcatcatttagctgtattatagtcttacatgtgtcctttacaattaatcaccattaaatgttagaaatgtaaaatttaagaggcaaagaaagcatacttctttaacaaagtggcccaaacaaataccagtattttaatttgaggtctgtaacaggtctacagattttattttctcattttgcaagatcagtgtatgaatctgagttcttttaatagatttttcttgcaaaatcttattgttaattgcaaatgtaagttgtgacagtaatttttagtataccactttagacttacttctggaatttgagcaacagaaacatattattagaactttttattatttctgtagctatcttttcaaatatttccaaaacgtatggctttttaagcctttgcctctgcaagtcacaatttcaagtaggcgctgaaattctagtaacgtgagcagtgcaacagtacattgagtcttaccagtaagttttagtgaattatttaggaagtgaacgttgattcccttatgagtcagtccagcctctttctgaaaatagtgttgttcccattatgtgtaccattttgcaggaaaatattgtattccaaggaactgggtgttatcagtaattaagtaggcagaacccatagatattgaatagtttaagttgtaaatgtgataaacttctataatacaaatatttgtggacagaaaatgctgtgagatatggaagcacaaagtagaagtagcatttatgaactgttactaagttccagacattttactaagtgctgaggatactgagataaataagaaataatccctttcctcgggaaattataccagtggtagaaatactccaaagggccaacagtgaaggaatcacaatgaattgacatattatgtactaaatagatctgctcacatcctgaggtctccaggcaaggtttacatgcacttgaactgccctgcataattgctattctgctgacaaaagtataggtgtggtatggtagagctcaaaggactctgagaagtcatatagtccaaatccttcattttccagaagaggagaaccaggcccagagagggtgaagggattttctccaggtcatgtagcaaactaacgacagttgggactataatgcagatttcttgatcctcagtccaatctttcaagtggagataacctcaaacctttttgtttccccattctctactttaagcaatggcacaagaagtccatgggaaaatgaaattccctaaatggggaaaagaggaccttgatagaacgctcatgagatcaataaagaaattaaaggacagggtgaaaaaatgtttaaaagtatgtagggagcacatatagaccagaaagaaaattaagaaaatcccagtggcaaaaataagagaattgcaaagaaagggctgaaataattatccaaaaacaattctttttatgggtaaacaggctaaaatgccataggtctaattttatgcattcaacctgcttcagaattttttttcaaactaaatagtcagctatgttaagtagcctcacattaaatggaagaactctctattatttagcacatttgtatagttgcaacgtagtgatgagtgatgtgtctaatgatggccccaagacagtgtaatgccccaatgtaccttttgagctattgaaaaatatttctattatgttcagcctagttttatttttaactatatttaatattcaaaatcttggaaatgggagctatgtttataatatctctggcaattatctataaatacatctaagttgatcgcagcacttcatatcttagataggctgtatagtagagactttactgtaacgagaaagatcctgaattgttaccctacttgtcttcccagatgttttctttgttaggctttttgggatttctgatttttcttgctctttttcttataaaatgtgaaatatatagcctgtgataatgcttggctgccctgcccaattattgaccaatgtcgatccaattatgcttttaaaagtatatattatgtaaatagattattttaccttctgctgccttataaatctttttttgtacagcagcaagggaagattataatgtcattggctgtcaaaatgcccttttcatgtaagtcagctgccaggcaaggatcctacatctgttttctagcatccatataaatgtctgtgataaataagtcattgctcactggagctgcctttgtgaagcagatcctgtacttactgtttctttcacatgcaaaatgacagcagtcaacctaattgactattacttggtcagtttctgtgtcagaagtgatgccaggtaagtaggagaaatccaaacttaatgcatttctgtttaaacccagaaagatttagtaatagaaaaaacagcaccaatttcaggtttttcagagatgagtgtgttcccaaaggatgaacttgacactactgcattctttctcacaacctaaactggattcttctatgaatctctgagtgaattcttagtagacacattgacatggtataaaatacatcacacggctgtaataaacataggttagaattgtggttcagttttcagccaaatgccaggataccattttcatatgtagtctttcctaattggaaatctagaggatggggtacaaaatagtcatcctaatctgttcaaacatcaatggacaattatgtctctaaaattctcaatactttgcaattaaagagtttttgattcctacattgcagagcaggcctcttcttctgtgactgatgctgccctctcttttctatgtcatctctgctttggaatcatcatcattacggggcatgataccagtcatgttaggccatgctgctgacaatggttactttcaacaagggggagtaaccagggaaaggacatccatcattatgtaatgtaggggaaaaaacccaaagactcagaagccatgttaacaaacacagctggaagcaaggaggcatttgagtaggattacaaacatcttagattgtgcagattagtactagatttagggaaaacatgaattgaacaacctcttttgcacaaatgagcaacctggagtttgcagtaatggagccaatagcctcatcacattttgaatccatttggatgtcatgtaaagaatgaacatatgcagtacttaataaagaaaggtcaattctgccatggtgatcactgaagcataatgcagcaaatgaggtagggcttttttttttttttaactcatcaatcctagaacatttaaatttatcttttcagtaagttgagggatttttttaaatctcctgcatctgttataacctaaatgaacagcagttcaaagccaactccacacctgtactgacatactaaaaatgtcaaataatttgtataaaaatgctgagatgcagtttcactaacagtctgttttgtcagtgtcctccctatttatcagattctaagaggattgttgggttgatgtggctctgtatatttccaattccctcctatttttggattgtactgctttgattatagttaacaaccaaccttgcaagaattcaagatttgtcatagctacaatactttttccacctcatagctttaacagtggcatttgtatgttacccaaaccaaaccactgagttcatcattttcatccaaagaagagtagcttccttgattttcagcataatgtttctggctatctagtgcctttttttttttttttttttttttttttttgagatggagtctcattctgtcgcccaggctggagtgcaatggcgccatcttggctcactgcaacctctgcctcccaggttcaagcaattctcctgtctcagcctccagggtagctgagactacaggcgcacgccatgaagcccggctaatttttgcattttttagtagagatggggtttcaccatattggtcaggctggtctggaactcctgacctcaggtgatccgcccaccttggcccccgaaagtgctgggattagaggcgtcagccaccatgcccagcccttttttttttttttttttttcagatggtaaactaaaaggaaataaaattgtaacctcagctggtgccataattctttcttggcttatagtttctgaaaggtgttgaaacgattacatatttatccatgagttccaaaattgcccctctaattcaagtcattagaaccttcttccacctacaactcatttgaactgtttttcattaaaagtcatgtccaagagtcagttcgagtgtcacgttatttggtcattccagctttcctcctgagtcttgtaaccctgactatcattagtgctgtatatagttctgtccacttgtctccttttcttatccagtagttcttggagggcatcaactatgctatctttgttgttttcacattgcttatacattgtggagattgaatacatttttgatttttaacaaacgttcaatgtgctcttactaaagcttggcaatgacctagatcaggggtttgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatttcttgtactgtcctttatcttttaaatattaaaaattagaagtaaatgagatgtgagatctaaaaaaaaaatgacatgaccttttatttatttccactggtcttttaatctaggctgcccttactcctcatagactatacactgcctcttagatactacactgctattagtctaaatactttgctttattatggaactgctcatttcttattccttgcatagatttagggttgataaactgagagtttaaaatgcagtaatggagaatcttaattataaatgaaggaaattgaaacatactactgtatgtgctgatttactttcagattcttgacctttgtcaagactaatgagattacacatctagtatagagaatggatagaaattttaatagacctgcctaatttacattgttaggaattctgtaaaactgagagttatgccagcaaacctacatgtgctgtctttttaattgcatttctccccaccaccagcccaccctcattccctaatatctgtggttagtacctatggagtcattacttacattatgaagtgacaaacataggaaagcatggctttgttctctgaatgcagataactcatatccatcaaagtttctaatttacagagctttcctttgaaggaggctagaatgctgagtaatgatgaaaaagcaacatttgttaaatctgatttggcgcaggacttctttttctacaaagcagtctttcataataccagcttgaatctaactatttctcttacgtagtatagggggaaagaaatatcttttcttcccatcttagattcatagctaggaccccttaacaacaacaataacaacaacaacaaaaaaaaaacagattacccgactaccaagagaaaagcatacaaagttatttatttatttatttatttatttatttatttatttatttattattttttgagatggagtctcgctctgtcgccgaggctggagtgcagtggtgcgatcttggctcactgcaacctccgcctcccaggttcaagcaattctcctgcctcagcctcctgagtagctgggattacagatgtgcaccaccatgcctggctaatttttgtatttttagtagagatggagtttcaccgtgttgacgaggctggtgttgaactcctgacctcaggtgatccacccaccttggcctcccaaagtgctgggattacaggcgtaagccactgtgcccagcccaaatttatttaatatacgtaaattttatgtgacacaggaaatttaattaggaaataaagacccaaagaaacaggaaaacctgtgtgttcttttttttttttttttaaattggcattcatgttgctttttttttttttttttttttttttttactattaggaacttttattattattatactttaagttttagggtacatgtgcacattgtgcaggttagttacatatgtatacatgtgccatgctggtgtgctgcacccattaactcgtcatttagcattaggtgtatctcctaatgctatccctccccactccccccaccccacaacagtccccagagtgtgatgttccccttcctgtgtccatgtgttctcgttgttcaattcccatctatgagtgagaacatgtggtgtttggttttttgtccttacgatagtttactgagaatgattatttccaatttcatccatgtccctaaaaaggacatgaactcatcattttttatggctgcatagtattccatggtgtatatgtgccacattttcttaatccagtctatcattgttagacatttgggttggttccaagtctttgctattgtgaatagtgccgcaataaacatacgtgtgcatgtgtctttatagcagcatgatttatagtcctttgggtatatacccagtaatgggttggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcattttttcatgtgtcttttggctgcataaatgtcttcttttgagaagtgtctgttcatatcctttgcccactttttgatggtgttgtttgtttttttcttgtaaatttgtttgagttcattgtagattctggatattagccctttgtcagatgagtagattgcgaaaattttctcccattctgtaggttgcctgttcactctgaaggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtttaaggtgtaaggaagggatgcagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggaagtatggccattttcacggtattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactgctgaagttgtttatcagcttgaggagattttgtgctgagacaatggggttttctagatatacaatcatgtcatctgcaaacagggacaacttgacttcctcttttcctaattgaataccctttatttccttctcctgcctaattgccctggccagaacttccaagactatgttgaataggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgccaggctttggtatcaggacgatgctggcctcataaaatcagttagggaggattccctctttttctattgattggaatagtttcagaaggaatggtaccagttcctccttgtacctctggtagaattcggctgtgaatccatctggtcctggactctttttggttggtaagctattgattattgccacaatttcagagactcttattggtctactcagagattcaacttcttcctggtttagtcttgggagggtgtatatgtcaaggaatttatccatttcttcaagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatccttttaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtatggtttctgccgagagatccgctgttagtctgatgggcttccctttgagggtaacccgacctttctctctggctgcccttaacattttttccttcatttcaactttggtgaatctgacaattatgtgtcttggagttgctcttctctaggagaatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatatcctcccgtagctcagagtaatttgatcgtctgaagccttcttctctcagcttgtcaaagtcattctccgtccagctttgttccgttgctggtgaggagctgcgttcctttggaggaggagaggcgctctgatttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgtggtgtcagtgtgcccctgctggagggtgcctcccagttaggctgctcgggggtcagaggtcagggacccacttgaggaggcagcctgcccgttctcagatctccagctgcatgttgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagattccgtgggcgtaggaccctccgagccaggtgcgggatataatctcgtggtgcaccgttttttaagcccgtcggaaaagcgcagtattcgggtgggagtgatccgattttccaggtgccgtccgtcacccctttctttgaccaggaaagggaactccctgaccccttgcgcttcctgagtgaggcaatgcctcgccctgcttcggcttgcgcacggtgcgcgcacccactgtcctgcgcccactgtctggcactccctagtgagatgaacccggtacctcagatggaaatgcagaaatcacctgtcttctgcgtcgctcacgctgggagctgtagaccagagctgttcctattcagccatcttggctcaggaacccaaacctgtgtattcttatgcttaggtttgatgaagaagtggagggtagtggagaaatatgactggacaaaggggatatgatctaataataataaagtgtgggggacttaacaaggcctgtgttttctgattcttttctgtgtccttgtatcttcagagataaggatgttcctttcctctgaatgtggggtttgggggtacctctggaatgaaggttttatggcctgcttcaagagagaagggcaaggggaaggtgagagtgaccttgcttctgctattttatcaaatgccaaggtgacatactgttggtagcgggtcttgaaccccatcagtagcaaaacaagggacttctcactctgaaaagctggtagattagtgaattctacatctgaaggattatactcataataataaacatataaaataagccataaggccgggcaccgtggctcatgcctgtaatcctagcacaccgggaggcggaggcgggcggatcatgaggtcaggagttcgagatcagcctggccagtatggtgaaaccccatctctactaaaaatacaaaaattagctgggtgtggtggcacacgcctactgtagtcccagctactcaagaggctgaggcaggagaatcgctggaacccggaaggtggaggttgcagtgagccgagatcgcgccactgcattccagcctcagcgacagagcgagacaccatctcaaaaaaaataataaataaaaaaaaagccataaggccatgaatgtactccatcaataggtatttactgaagaaatactatgtgcttagtactgtgggaaatataaatgtagaaagcttgctctgtttacttgggtaatcaagacttataaaaaataaaagaattatatgcaaaaacaaatatgtaccaaaatgatgttctataggtttcatatatcctagaattttcaaaataatcaaaattcattatcacatcacatgtttacatttttagtgcaaaaaataggctctgtggcaataggacctcagagaaggacaagatcactatagtttgtgatactccaaaaagtcttcacagaggaggcaacgcagcttgtttatcctacagatattgtgtcatctcttttcagataattgtctgattatacctgtggctatttccccctgaatttcttactagttggtttttggttttgtttctgtttttcaggataaggtcttgctctgttgtccaggctggagggcagtggtgcagtcatggttcactgcaaccttggctcaagtgatcctcctgcctcagcctcctgagtagctgggactacaggcatgcgccactgtatctggcctgtttttttcttttatcttcttttttactcattcataataatgcagaattagaagcaatcccatgtctttgttttatctttatcgaggtataattggcaaattatgtatattcaaggtgtacagcatgatatttttatatgcatatacattgtggaatgatttctacaatcaagctaattaacctgtcacctcacatagtgatggagtccatagtgatggacctcacaggtttttttcgagttaatttttgcattgcttcaacactgcttctaccagagtccccattcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaaattattattttcctcatattgtaagtcacctggatctacaaaaataggctaaaagacagttattaccacgtgtcatattcaccagttctctcttttctttaaaaatgcttagatgtctttaaaatggtttttaagtgtttaaaggaatagtagtccatgcatagccctcagtatacctaagaagatgaagtatacttgtgactctgattgataagaatgcctgtaattttcaacagaggttactgtttcagtggtggcccagatatccatctgtcagtctttgtcaaatagcttatttgttatttttctgtagtctcttaaactgttattttttatttatttttattttttatttttattttttttgagatggagtctcactctgtcacccaggctggagtgcagtggcgcgatctcggctcacctcctccccccagggtcaagcgattctcctgcctcagcctcccgagtagctggcattacaggcgcgctgtaatttttgtacttttagtagagacgggttttcaccatcttggccaggctggtcttgaactcctgacctcatgatccacccgcctcggcctcccaaagtgctgggattacaggcgtgagccacagcgtctggccccttaaactgtttttgttctttccatacattcattccctacccccctgctttttcccaatgttccattctaaaagtgaataaaaaaattcacctaccaaatctggataacaagaatgttatttcattttactttaatctttgctattcttagaccttcttttcttcttcatcttttccaattgaaataaaaaagatttttgatgtatgtacaggctatgtttttttaaaagaactgttaaaattgtgcaacttcaaagcgtttccaaatgttgcattttcaaaaatgttttatcatatttttctttaaatttcctgttgctgtgtagtctcaatgatggctgaaggcactgaattttacattctatattgctttttgtgttccacatctagttagtagttataacttctcccacacaataacagtgcttttgtggaaataattactcaaagatgatttatttctaatgattttttcatatcatgattttaaaatatcttctaatttccacttacataaatgttttccttctctatttagatagaacacagatacatgttgattacatcctaatctatccttcatctacttcccagaaagatttcaggtggtttttgcaacaaaggcccattaaagttaaattaaaagttagagggaaacttttacacaattattccaaatatgtaaattaaggctagttactattattgagcattaaatttagctctgagcttactggaagccaatacagaaaagaaaacatgttatgttttataattcttattatctgacgaaacacagacagtttaaaatggaagacgaagtacaacattgtctttggtaatagttttagagatgatccaagaacgttcttcatgatcacttgtttcatcaacgaaccactttcatactgcctttgtgttcatttatgaaacacaattaaatattgctgttttggtctaaatgtgtctccccagaatttgtatgttgaagtctaccctccattgtgattgtattagaaggtggggcctttgggagttgattaggtcatgaaggctctgccctcatgaatggaattagtgcccttacagaagaggcctgagggagcttgtttgccccttccaccatgtgagggcacagtgagaaggtgcagtctatgaggaagcagtccctcaccagacactgctggcaccatgatattattagacgtcccagctgccagaactgtgagaaataaatttccgttgtttacaagttacccagtctatggtattttgttatagcattccaaatgaactagacaattgcatttatggaatacaatttgcaacacattgtacaaaatgatgtatattctggaatgagtcctcttcccactccttactcccctttccttacatacacattccttgcctttcctcacccccaacaatagttctgggacaggaagattttcatttacttctaaggaggtataaaatcttgatatggtttggctgcccacatctcatcttgatttgtagttcccataatctccatgtgtggtgggagggacccagtgggaggtaattgaatcatggcggtggtttcctccatgctattctcaggatagtatgttctcaggagatctgatggttttataagaggcttcccccttggctctgttctcattctctctcctgctgccctttgaagaggtgccttagccacaattgtaagtctcctgaggcctccccagccttggggaactgtgaatcaattaaacctcttttctttataaattacccagtcttgggtatttcttcaaagcagcataggaatggactaatacaaatcttaattcttcttgtaaacatttattgaacaccaactttgtgcatctttctcttttcaaattataaattatttcaaatgtacagaaaatgttatccctagaactcttaccaaacagactttatagaagtttgtgattagtaactatctgccaatagaagtcatttgcacataggtcctagaatcatagaattttaaaggtgaaaatgaggttaaagaacattcgctaactccttccttttacataaacattaaggacttatataggttcttatacctagttagtagaaaagttgatgacagaacttacgtcctctagtactttttctactataccataatatagatttgctggattatatatacattcaaactgtgcttctattcctgtatgtgataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcagatagactcatgggggattcctttgtccctaactcctatctagagtacttccttttcctaatatatatagaaatgatttgaaagaattctaactaacctcagatatggagataatgaccacgattaaatggactgaacatctcattcttatcaattccaattcataatcctattttatttaagtggttatctttgtcctttggaattccaatcagccaaaggatgccagtactgttaataataccgtatgccaagggaaattatttcctctgcttccacgactaccagggttcactttgtggaagctgtgtgataacataatccctcttacccaccacctcttttgggcaatatttgaaaaatgaaaaagggaaaagagctgggggagaaatcattcaagtaaatttacgatagtttcaaaaccagatttgctcattaaaaatagtacttgaaatagatagcagctgtggtttccattttgtaatttttttatgatctatttcatttctgttttctaagctacttaaaactgttgtaagctattgataatataattttccccaaattatttggctcctcatttcattttccctgctgtgttttataaaatttcatatcagaaataagaattaactagatatttttgaaatcatgagtaatttttattcactgtagaattagatttcttttaagaaaaagaaagctagtacagtaaaaatcagcatttcagatgtgggtggcaagaattaactagattttagagtaaaccgtagaatagtaccctcctctttgctccttaccatactttgttttctgagcatttatcaccacccgtcatgtatttatttgttcatcatttgtcttctgctccccactgaaatgtaacctccatgagagaagatgctttaactcctctagttacccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaactgcagcaatcttctaaatggcattccagcttccagtcttgtcccccttcaaatccctgcattcttttataattttgcccactgtgtccccctgcctggactgccctcccttgttcttttcattggatgaactcctgctcatccttttaaaactcaattcggccccatcaccggggggctatgaatatactttctcagttcttgcatggtgctttcagcatgttgttcccactgaattcccacactgctttgtctttgtttctttacctgcctgtctttcctattagatagtgagctcattgggagcatgtcttatttatctttgtagatccggcattaagcatgtcattgggaacttaataggcccttcagacatttttgaataaatgagtagatgaatgaacaaaagaacaaacagcaaacaaagggtagccttgaggtacagtataagtatatcaaagaatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgacagaattttctttaggatttacatgagtctaatctgatagaatggaggaatgtaattgaaaactaggaagagaaatctaggcatggaacttcatcatccaaacatttttttccctgattaaaagcaacatatcagcgtgtgtttttcaaatacaggcagtccctatcttacaaatggctgtagacagatgtagggcatattattgtttgaatcctgattacccaagtgggaaaactttgctttagatgtcagttgtttggaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaagaactcactcattaccacaaggaggacatcaagtcattcatgagggatccacctccatgacccaaattcctcccatcgggccccacttccaacattggggatcaaatttcaacatgaggtttgggggataaacattcgaactatggaaagttgtatggactatatcttggaagacggaaggatatgttggaagtgtgctaccttctaagtgtcaaaggttgagtcagagaaacatagagaaaaaaaggccaaggtgggcagatcacaaggtcaggagaccagcttggccaacatggtgaaaccccatctctacaaaaatatatatatatatgctggacatggtggcacgtgtctgtaatctcagctactcaggagactgaggcaggataatcgcttgaatccgggaggcggaggttgcagtgagctgagatggcgccactgcactccagcctgggtgaaagagcaagacactgtatcaaaaaaaaaaaaagattttagttctgttgcacattataaatggaatcctcctttgatatccttggaaaggatttggtaactacttatattgtttttcagtcatgttttgtattcacattcatttttacttggatatgactctgtactggtagggaactatgaggcaacttggctttattcaagttatataggtgtgatagatttcccaagatcacattaattgagctgtcagtgggggacaaaagagtatgattactctaaagaggaagaatagaggaggtagaagaagacagatatagagccacatagttaattctctttgctgtttaccagctgatgaaccaacaattattcaacaattttttactgtgctgtgttctaggcaatgtgctaagtgcttagagatgcagtggcaaagtacttggaatacagtagtacacatgatattacatctgccctcatatgttttacagataaggggacggtacagataagtagataaggaattataatgaattatgttaagtgctaatgtggaggtactgttgggtattaagggcatatatagaaaaatcacctaaatctgactttcagaattagcacacatcctagagcattctaaactgatatagaaagatgtgtcagagtgaaacaggaaaacagaagttaggcaagaggcaaatattcctgaaagaagaaataatgtttaagattcaatcatacaacaagaagcctagagagagtactgggaaaaaaaaatagccaaagagagatttctacttctgaaaattgtatagtaacttgtggcagaacaatgctctgccaagaatatctacataagccagataacagacaaaaagtctgtttgaaggcattggaaagtagccaagacagccagggcttgagaagttaaaatctcaagcaaggaaaactacagagaaatgaggcatatttccttttggggcatttgccaattcttacagcatgatacagagaagtcaccagaagttccagctatcttataggcttagagagagaggaaaacattgagggctgtcaaggcagtcagtactgaagggggccaaaatcctgaagagagtggatgagtagagaaatgaacttgcactcagtagttttaacctccaggcatttgccaaatccttaagctgttcatgggatgaaaaagcctaacccgtcaagcagtaagtgactgaaaagcagagtggagctttcccactcatagtataaaagaaatagaaaataatgttcagggccctccacagaggagcagccccaagaaacaccccagcatttcatttgggactcttaaagaacctaccctttaggaattggtatgaactaaatatagactgaacttttgaaagactgcaacttcacctatttgttcgttgattccttgattagattaaggtgatctacctctactccagctgcctataaatgatagagagaaccctctctggaggaaaatatcatctagtggctccaagatttctgcaaacaaaatgtctatatttaatcatgcattaattggcttatgaagaaactgaaccaagggaaaaatcagacaatagaaatagacctaccaatgagtcagctgttgacattctcatagacttttaaattagcatgattttttaaattactatgattaataagtttgagaaaatagatgacagtattgagaatctctccaaggaactggaatccattaaaaaataataaagaggtaggaggacagtgacaattagtgaaaactgtttcaataaggaaagagtagctgatactgacttatactacagtgaggtcctttggatatagtaacaaggagcacaggtactaagaagtcctttgggtttcataggtagatcgttggtgagtgcaggttcagtggagtggtgggtaaagaggccatgatggtgataaggtcagatttgaggtgagtagggaaggtgactatggaaacatgaaaggtatgatgggcttaaaattttggtccattaatttgtagtgtcataaatctattatatacgactctttaattttctctagaaacactcatcgacttgattagaaataatagagataggttgtattgttctccttccgtcttccccctttcccattccttcctctcccttccccttccttcttccagtcgttttccatttttacttccttttccactactattttacattatttttctttattcttctttccttttcttcctttctttgttttctaatagaagaaatagaaataacatttgtagattgaggagagagagcttgtatattgagagacctcgttagactcaaagcatgccatcataaatctgagatatttagaatatgtattccagtaaaatcggctaactaacttaatttttacagacatagcatacatcacagttaaaatgccttttagaggcccattctgttttacaagaccaaaattaaatgtatatatgcttatatacatactaatgtttatctgttatgtgcacatatctgtgtgcatccatgtatgtaacaactcagtgttttactgaagtaaatttttaggattgaaagaaataggtttctctagttgtatagactgcttatgagaacattacaattcgatatgtagagagatgatgattacaatttattagtccatcaccatttggaacaatagatggccaaatgtaattaaccattgaaagaaatacattttacgtgtcctaaatttcatttctaattacttgtaactgaaactctctagaatcttaaaatccattttgtcttatgaaaggcttcattgcttatccctgttgttgcactattactttagattagagtaacttcattttaaaattacatgtcaaatataatttgctattagtaacgtggaatgtgtggcttcactctgagaaaaaagcctgttcagcattttttaatatcatatacctaaacagagcttccacgatgattagatcacatctggcacaatgtagatctatttgtacttgcataatgcatgtgcatgtacacactgtgatattttacgactatttgggtacattgatttttctataaagagaactattatccacatctttttgcacagaagtacacttaaatattggcataggtaaacaacttactaaaataaaactcgtgcttggcacaactattactggtgtcacagattttacaactataatatttctgaaaagctagcttgaacgctttggaacatttttttctgagtgaatgcagaggcagtttggtgagctgtaaaacttctacttttcattttgtattctagtctaggccaaatcttaagtgtcactaaatctgattctatcttgaattgtggcccagtgtcatccccagaaggaggcttctccccagcactggctaggtaagcagcctatgtgaaacaaaggaagcggctttgccagcaagcaactattaagaatgggaaagagtttgaaataggctaacgaaatgcaaaaaagtaaatccaaagtccaaaagtagaggcagctttaactctgcactatttttatcttgtgatcctgtttgaagaaatgtctcaattcattataactgaagtaaaagtcactagcataatatggaaacaatcttaaactggtaaatattccttctccttacttaacataaaataaaacccatattaagatattagttcctcctcgtcagcaggggaagtctctgtatagactgtctgaggacatggcagttgactgacactagagtgggcaatcccagagactggaaattgatgtcaaaaaatttggttttgcccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgtagtgatctgtatcctctgagtagtttactcattctaactcaaccaaaatgagcagaaattaaaagcaaatgatttttgctctagaatcaatacttatgttcacagtcagtatatatgctctgcaacaagttgtactctgggtatacatatacaaaatttcagtgttgcttaaaaaaaaagcatttttattgacttaaatggaagaattctatagttttttaactactttagttttctggaatttgtttactttaaaacttttcagcctttgcttttccatctctttaacaaattatcacctcattcatttagtcatgttctatttaatttatatatttttattcttttgcctttccacattgcctaaatccttgtggctaggattacttaaatttttctacatggttttcattcacccccattcttataaattatgtgtatcatttatttactaaatatcttggtcatgttcaagaattgaagatgagagttttcagttatcacattgaaaaagattaaaatttattatatacatataaatattatactataaaaatccttatgtaagttctgcaaatcagtattttatatatttagtgaactgcacaaaaggcaacttctattcagtgtaataaccctaattttatttcttaattttaaaattttaatcttttctacttaacattctccataaatagcttattgtagtgttacaatgaaagaaaaattttaacatcctcatgaatcctgactacttagtatatacatatgtaaggtgaaataggttaaatagcttatgtgactattttctagttacttcattaagtctctaatgccttttggataaacaaaaatgatgaaaagtaggtcaattggctacctcagccaggtgatcaagatcaacatcattagagatagtgataagacaggtagataatatgttctcttcatgcaatgagaatggcattttgcctctgtcttccccgagaacatataaccccagtctaattatgcggaaattgtcagacaaacccaaattgagggacattctacaaaatacttgaccattactgctcaaaagtatcaaggtcatcagaaacaaggaaagtttaagaagctgtcacaatctagaggagcccaaagagatgtgatagctacatgtgatgctgtatactggctgagatcccgaaacagaaaaaggatagtatgtaaaaactaaggaaatttgcataaagtatggacttcagttaatgatgacttatcaatgttggtttatttgtttgacaaatgtagcacactagtataagatatttacaacaggggaaagtgggtacagagtttatgagcactcttatactatctctgcaatgtttctttaaacctaaaattattctaaaataaaattttattttaaaagatatgtgtattgggaaagttaaatgttatatgaacagtgatgttggattcttaaaatcagaaagtccctgaaagtataccataaaatgttttttttctaattgtatttatttatttttttgagacagagtctcactctatcgcccaggttggagtgcagtggcatgatctcggctcactgcaacctcagcctcctgggttcaagcgattctcctgcctcagcctctcaaatagatgggattgcaggcacgcgccaccacacccagctgatttttatatttttagtagagacggggtttcaccatgttggccaggctggtcgaactcctgacctcaagtgatccacctgcctccgcctcccaaagtgctgggattacaggcgtgagccactgcactcggccaaatggggtttttaaatacttggtaaagaatagatcatgcccaaggtcactatcatctagctttatattttttaaataacaaagtatacaaatatatactgattattgtttcaagtactatatgttatagagaataagaataggaagtgattaaaagactatggtcccagtacatggtaacattggtgaacacaatttatacaaacaacagagaatagagtcttcattccaaccttttacacatccttagggaaagtgctatgtaaatgatacaattgctttatacttcatagggataccacacaaagggaacacttttaatatcaaaggattctaagaatttcaagaagtttactaaatgaggaattagaggaagatgcaggtaagtatatcataaggaaatataattttaaaagcttatcagtgctaactcaggctcagctattataatatgtagcatcttatggacaaggacaaaataaatctcactgaaaacttaagaccatttttcaccttgaaaactcaatgtggaattttccatgaagagcccttgtcatcaaagcactcagatatagtattgaccatatgaagccacactagtacttctggctcattggaatgaaaatatcatatgagtcagcttttaaattttttaaaaattctattattctgatcttaacacattattactacatgaaatttatcctcaacattttgactagctctttttaagtagactattgtacaggtatgacaagtatattaaaatacacataacaatttcatatttgtatcagagtatatcaaattaccaatgtcttcaaatattccatgctagaaatacctgtttgtagaatttctgtactggatcacttacctcttctttctatagcattttggcttcacacctttctcccataaatccaacagttcagttacacttttttcaagtatgtttaaatattggattgaaaatcatgtaccctgaaacctcataaaactctgtcaccaaagagcatgtcatcagattgagtgggatacaatacagacctggattatataaaaattatacgaaattgtacacaagcaattaagtctaaaatacatttctttactgctgaattataagcacggtattgtgctaggtactgtaagggttgaaaataagctgaataaaccataatctctgttttcaaggaccatatagttcattggaggaagcaaacatatatattcacatatttttattacactatatattcatatttcacaatagaggtaaaactgaattatatggacatatggaggagagaaggattgaattttactagggacatctcagaagcattaagggcagaaaaagtatttgaattgggccctaaatgaatgcaggaaacgtcagtaggtaaaaatgggctaggaggatagggaggtatttcagatagagggggcataaagatggaaaagcatgcaatgtttacaagtagcccagtgcaactagagtgagaagtcagatcctggaaggccaaatatatgactggggagtttgaacatcattctgtattagaggtttttgagtggtagaatttcaaaatcctatcttatatttgaatgtctattgggcaatcatgatagacgggaagagacagaaaccacttaagtgatgctataataaggcttgagtttatttaagtagatacgttcacttaattttaacaggttagttaggtgtggtaaacagcctctaagatagttccgaatgattcctgcctcctggtattcatgttctttgagtttggggttggcctagtgactggcttctaacaatagaaggagaaattgatgggatgtcccctctgagattaggttataaaaagaatgtggttcccttccatcttctgtgctcactctctgtctcacagatcatgagcttccatgttgtgaggacacttaagcagtttatagagtgggccacatgtccaggaaaacctggttgccagcagccatgtgaatggacttagaagaaggtcttgccctggttgaaccttatttgaaatcgaagccttgatcagtggcttgactataacctcataatagaccttgtgccagatacactacttaagctaagactaaattcttttttttttttttttttgagacagtctcgttctgttgcccaggctggagtgcagtggtgcgatctcggctcactgcaagctccgcctcccgggttcacgccattctcctgcctcagcctccccagtagctgggactacaggcgcccgccaccgcacccagctaattttttgtatttttagtagagacggggtttcaccatgttagccaggatggtctcgatctcctgacctcgtgatctgcccgcctcggcctcccaaagtgctgggattacaggtgtgagccaccgcgcccagccaagactaaattcttgacatatagaaactgtgaggtaatacatatttattgttttaagccattaaattttgccataatttattaggcagcaatatgtcattaacagaagtcaaatccaatatctagcctggtttatctttgtactaaattattgaatattttatttctatcatttctatacataatatggcttaaagattactgaattataaataaaatctagaattttctccatattgcttagtataatcttaactattatattgtgaaagctttgtgatcccttgcatttacagcttttagagaaatgaaagatacaggatttatatgtaagagaggtcttagaaacctattttgaaattaaacatttttaatattttctgttaatcctttttaggaaaaaaaaatttgtttataaagtttttactaaagttaaagaacactaactttatggattcactgcagctttgataatgaaaaaactactggaaaagaattaaagaagttgctaatcagttcattaatcaagtgtatctgctgcacattatactgaaacaaattgaaaaggatgctgtgctagccagaaactccctctcaaataaagtcaaaagtgaagataaactaaattgacttttcgtttgtggttgatttctatctaagtagatccatctctaaaacactgaataaagaaagttgccccatacatagattcaagactccactaggattctgtatcttaatactactgagaataacttgaactatatttaatcagtctgtctttagtttttgtttttcgttttgttttcatttacaacccacagaccactttcatttttaaatgttaaatatacttagaaagaagaagaaaaaaacaacatcaccttgctcactgcattaagacaactggttttgtaacccgatcaaaagaattaaatagctttctatatagcttaccctcccacaaaatctttcaatgcacaaaatatttgtcagtggtcagaatgattccagtccatcccactctctgtggtgccttaactataaaaatggcagtgaggcattgcagcttgaaaaaaatacagtcagattttcaattatgattagagtagatctcccagagaggtctccacagaaggcccaaggttctctaaagggtaaaaggagtgacaaaattctgacataaaacaatgtagtctttcctctcttttcttgataccgaccttcaaatattttggggtttttaaaagccaaattctagaagaaattgaaggttcaaaattggaattcgcttgagtttcattaggtttaagccagataccagcctatgtcattttctaaaagcagaataatttagttttaaagcaatagtacaagacgaacaaacaggtacctggcaatcacattaagactcccttggtgtagacagatatgtataacttcttttgacaggttattttgtttattcattcatttaattttggcacttaattttaaaagagcttagaaatcatagtcttttgatagatataattggtatgaatctgaaatcagtaaactaagatgcataagaaatgtaattttctttattttcttgtaactgaattaattctatcttaagaccctattctactggaaggtaccatggaagataagaaaacaaaccacaaaaaaatacacaaatttatacttacttcacatactgtccccaccatgttataaggatataatactcatccattaagacatgagttgcatgtttaccccattatagattatttaggattatgctgaatttacaagtgaaggaaatgagcaaagaaatgccactggataaacagtgttttgctttccagaagcattaatttaagtgactggcccatgattatccatctgctctatcagtgaaagatccctaaagacaatgcttgtcttctatccttgtcatactcagtacactgttcacattagcaagtatttgcccaaaattgctcaatttgggatacagaatagaaatatatgtacagtagtgagtcactgataggatctgagtgaaaattttttacatttttttaaggcttagatgaatggacacagttttctattgttttgtttacctttgtctggtttcccttcccacccccatgcacgtgctcatgtgtgtttaattaaacaaagaagagttccaggaagttgggaatgtcaaatgggaacagacaccttcgcaggagctgagaaaatatgctatatcatttatccttgtggaaacatgcaaaccagatttgaatagtttttaattgatttgcaaactttgcagtagaattttctggtaattagcaacttgctgagattaagtgaagtcatagttagcttcacagtggtttaaatcatatttcattgttttgcatgttttaaaagtcatgttgtaaattaaaaacgcaaagaaaaaatcaccaacttattaatagagaattgatcattatgcaaccaattagaagatataaataaatatacaaatcaatcacgtataaaatggtaggtgctgcagaatgttaacactgtacaggcaagtgcttgacaaataataatgagctataaagatagactagaagcaaaacagtaatgtggcagctttgttggaaatattttctagaaatgaagatgcatgaccttccgtacctttgttaatcatcagttatagatagttaaaatgttatatttacaataattctgtgacttttaaagtaattgtttatacaactacattgagcttactagtggcagtatgttcatatgtacatgtgtctctcttgagctctcaggagagagaaaaaatctgaggaagtgctagcaagcataagcagggagataagaaaaataaactatcttataagtacaataaaaatcacccatgcctcatggataacctaacttcccaattaaacatgacgtttcctccaaaatattaagcgacaaactagaattctgtttcggaagccaaggaaattaaagaaaaatagagtcaagggttaagtagaagagaagagacttaattacatttagcaagggtcccaatccacttagatacttactagggtactcagcacttgttcactgcagcatttgcatttagcacttttaaaattgggatgaaatgagttttatagatactagaggaatcattatgagatcacaaagaagtactgtgataccataactgaagctaggagaagggaaagcaaattcatatcacagaggaaagcaaacttccatcctctcaagttatctttccagtcaacattgccgcatatcacatatggtgtgcaaaaggggacagattaatgaagtactcaacaggaaggtataacaatccaaaatatgtcctttgtgactctctatccatttctgccatattccaaggaaatgcagatgtatcttcatttctatgccatgatatacttgggctgggaatgggggacaaacccagagtgattgttctcttttcctgtgttcatagtgtatatgtgcacacacatgtgagggtgagcctacacctgttcataccccatggcagtctgacttcactgattactttctagaatcttttttcctttatgtgccctggacaagagagtggacaggaaacatggtaacaaaaacaaagataaacatccttctataattctaaagaagcatttttctgtttcctcctaggagaaataaaaatgtataatttaaattaccaattaggatcatgttgggctttaaaatttttggggggtaaattgtatgagggttgcaaaaaagtcatgcagagaaagatactgaaatctcctaatacaacatgttgagaagaaagttaatgatcagtttttctggtagtttttgcatataagcctacttggaagcactgtgtaggcctaactgacgttagtgaatcagcagagagctgatttgaaatgcattatccgataggcatgagattaagcagtttgataggcatcttagagctgtttccatggccttattaatttgtaacagttgtgtggtaagttatgtcaacctcccagtcagaaagtcttcagtaagtttttcaggctccaagttgagggatgggtaagaccctgggacaacaccctagtggaggcttataggagagtttaagcatttctgaatgcttaaattctggatgctacattctggatgctacaggcccagaattccacactaaagtatttgtttggagaactcaagtatattatgggtatcttatttgtattatgtgtaagtaaatatcaacataggtttgatcatttaatcccatatcctgattttgctctaagcgaaggcagttatttgagtgccagctcagaaaaggtaattcactattacctgttaagtgtgatgaaacaggacttctcagcatatctttcttgatggtattttaggttcaaagctgatggattagctttttgccctttcacacattctacctatcagtgacaccatggccaagggagacaatccaattcacttccctgacagaattgtgggtgatggttatatcattacgtatcctggaatgcaagactctgcttgtattgatcttaaacatataagctaaactcagtagcaaaaacataaccgatatatggtggggaaaacgacaagggagtgttttctaaacccaagaaatactcaataaataggctaagaccaagatgaaaagtgcaaagaaccaacaagacaagagtagaaagaatgcggggctcaataaatggtattattctcagaaagtatattccattatctgttgttgtagaacaaactacccaaaacttaatggcttaaaatcattgttcacgattctgcaatctgggctggcttcagcctggcagttcctgccactagtctcatctgaagtcactcacaaaactgcagcccattggtccagggtagtcccattcatatgtttggtggttagttggcaatgtcagcccagcatttcaaatttcatggcttctccagaagggagctcaggcttcttacatggcgcatgtaatgttccaagaagtcaagaatggagactacacagtctcttgagtcctaggtcagaagtcacacatcattacttgtactgcattctgttggtcaaaggagttcacaaggccagcccaggttaaaggggtaatgaaatggattccacctctacatggaagaaggtgcacatagtatgtgtccatatttaaaatgtcacagaatttacaggaatatgaaaataatcatggcaaatgtggtgcattcttaggaagaatttttttttcttttttctttttttgagacagagtctcactctgtcgaccctgggctggagtgcagtgatgcgatcttgactcactgcaacctccacctcccaggttcaagtgattcttctgcctcagcctctcgaatagctgggattacaggtgtgcaccaccacacccggctaattttttatatttttggtagagatggggtttcactatgttggccacgctggtctcaaactcctgacctcaagtgatccgcccacctcaacctcccaaagtgctggaattacaggcgtgagccaccatgcctgcccaggaggaactatttttaatgtccaccattgtatagtgctcccggtacagcctctatttaacaatttttaaaatgtctctacatattttgactctcttaaaagttaataataatgagaaatatttacattgtattcattcaataaacaagtactatgatttctctatcgcgctcagatctatcagaaaccttaaatgtaaatagatcgtttgatgctttattataataattgttaaacattcttcctaagtgcattattgaccattgatagaaaagaaattgcttcatgttatacttattcatcaaaagcacaagaagtgcccttccctgtcaaactccttcaattgtcaccccagcacttcactagagatacaaataatagcacatgaaattgtagctggaagggaaggggaagactggtaaggcttatttaaattgcattccaagcatagaaaacatatcttctttccaaaaaatgaaagctagtacaatattaaatcagtaatatacatacttaaaggcatattattttatgtgatatgttaaccatgacatagagtatctcaaaccaaagtgattcaattgtcattaccatcaacaaaatgaaacttataagtggattgttagcagcctctttttagtttgttgtagagtgttcctctaaagagaggagaggccagaaatcatctcagtacacagacacagtgttgctgcatctccatttttccacaccgattttagtcttgatattacttccctgtggaggctgtctgaaagctaaaagcctatacagaagtaacttaggccaggtcatttttacttactaaaagtcagttttcctataacatgtaccacaagatgttactttaacagttttggttcaagggtcaccagactgtacagactaccagagcttcagcagtggcattctttcaggtggcactctataagttgtctgaatcattgggttaacattctcttcatgttttcatcttagaaaggcaagttaacgtatttttaaagaggtttaagaaggcttaagaaaaagtaaactttttttaatgcattgaaaaaataattttacaatttattcaattcccagagtttttattacagacctactatgtacacaagcatggtgtacccggcagctgtgagaatagcaaagacacagcctcagcctcccaaagtgctgggattacaggtgtgagccaccgcactgggccccagtagatcttttctgtgtatattttcccctactcctctcatctaccctttactccatcctaagtgaatgatgcccttttctctgactatatcttacctttcctacctctatgtctttgttgatcactttcaccctagccactcttcaaggctcgtttcaaacacagatttcttcatgaagacttttctcctgaatacacacactgctacctcaaatccaaagctatttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattttcagttttcatctttcatcattttttagctactcatgtcttagatttaaagtcccttaaaattataaaaggttgagagactgataaacaggcataaaaccttgtagatttttttcccctccactctttttttctaactaagctacacagtaccatcacgtaccatccatcagtacatttagctgtcatgacgctgccaatagaagttgtccatccactaggcagtataaaattacaatcacgatcttcgctgggagtggcagctcacgcctgtaatcctggcactttgggaggctaaggcaggtggatctcctgaggtcaggggttcaagaccagcctggccaacatggcaagacctcgtctctactaaaaatacaaaaattagctgggcgtggtggtgcatgcctgtaatcccagctactcgggaggctgaggtaggaaaatcactcgaacccaggaggcggaggttgcagtgagccaagatcgcgccattgccctccagcctcggcgacagagtgaggctctgtctcaaaaaaaaaaaagttacaatcatgttctcagtgaggcagtaaggtggaagagtgtatttctttctgtgtagtatgactatatgacctcatgtgtgtcactcacttgcacttattttcaaataccaggcagcagtttgcttgaagttaactatctgttttatcatgcaacttaagaagaagttgtaacacatgcaactccaaattattcttattcataactctgttctatagtaagcatttgaatatggatgcagctcatgtgatgagcatcattctacttgacatgaaggaatgagatccaactgcgaggaccccagtcagaaagagctgaaggcccattgatgcctcaccttttctccctgcttcccccactcttgctagggatcattggcaccaccactcagactgatggtaaaacaagaaattgtcttctgtctagctcagacacatcacttgtccaactcaacccctgctttgggtacaggaagttttaatctggttaagttgaatagagtttgtcttctagcttttgctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacagaaactactcccttctagagaaaagagcagacctgaggataccttgtgcaatccaaagtcaaattccctattcattcattcattcttattttgtgtgtgtctctctctttctctctcttgtgcacctatgcacacacaatttttggtcgatgcacaattttaaggtcatttttaatctaaagaatttgttcccctcttctttcctgattacatggccatacagcctgccccaaacagtatgactcactctccatgactcttctgcggctctttgttgtgagttttcattttgtgcctcatttctgaatatgctctaaagagcagggatggcctttggctagaaagaatggcatgtcaggagggttccacaagccatgttgcttttctgaatcatgaaaaggcatcagcactcagtgacatggcccagttttctaatctaatttaattgaatgtacaatgatgtgggcactggagattaaatacaaccccacttctctgcaaagttcacattgcctttaaagcaatgtaatatttttttcatttcttatgaatggttctgtgtatgtgtcatgtatacttttacttgtattctctgtgcaaagtgataccttaaaaattatctgtaaaaagtctaatataacttggtcttctggaatatggcctgatttaattaattgaccaatattactttaaaccattatattgcagtgaaagttttttcttgtcacagtaggaactagagacgtgtcctaacaaagtactaacttatttgcaactgatataaagtgaattaatatatttgttacttttaaaagagagtgtattttggaattttgcagttatttgtatattaaggcccacattaagggcctgcccatttataaaatgacgggtaattttcccaagtgctgataaaatattttatcatctaaatttgaaaagaaaaagaaactaattttaaaacatttctaatttataacattttgtgactaacttactttttatttaatttatttcctttcattcccctcactgtgatccaatttgtagacaggcaggcttgctaaatagcttcagcatttgggtttgatttactgtgaagtagatcttagaaattaaagtttcaggttgaaatttgcctttcagatctccttgcctaaatatacatgtaaatttgggagtaatctaacatgtgcataaacacattcaaactattttatagctttaaaaaaattatattgaaataattttagacctacagaaaagttacaaggttagtccagattttgatacccccttcacccagattccccaaatattaatgttttactgcatttcctttattaatcttttttctagaaacacatacacacattatttttttctgaatgtttcagaataaattgcaacatgatgccccttcacccctgaatacttaagtgtgtatttcttcaaaataagaacattcttttgtataatagtacatttatcaacattggtaaatcaacattgataaattaccacttaatctatagactttatttaaattttatcagttctcccactaatattctctatagtaagagaaaaaaaatcccagcccacatgttgcatttagttatcatggctcttcaacctcctttaatctggaacagttcccctgccaaaaatgcatatcctgaatctaatcatgaggaaacatcaagcaaatccgcattctacaagataatttacctgtactctttaaaaatattatagtttttagagctatagtacatctccaagtaagcacataggcatatctacatttttaattttctctaagaaagagcaacaattcaaaataatccccaagtatgttttaaaataaaggcttctttttgaaagtcaaagacaaatgctcttagcctaaggtttcatttaaacatagaatggctatttcaaaaaacagtattacataaaatatgggctgggtgcagtggctcacgcctgtaatcccaacactttgggaggccaagtcaggtggatcacctgaggtcaggagtttgagaccagcctggccaacacgatgaaaccttgtctctaccaaaaatacaaaaattacctgggtgtggtggcgggcgcctgtaatcccagctactccggaggcggaggcaggagaatcacttgaacccaggaggcggaggttacagtgggccgggatcctgccactgcactccagcctgggcaacaagagcgaaactctgtctcaaataaataaataaaaataaaatatgtattatataagttagggacaatctggtctttcatatatagacttcagacaattggttgttcattctggagttgagcactatttctctcatgggctcttaagctaagaacatttagctacatgtcgggtatgtttcttacattctgcctcatgaccatctcccactgccatgcatatgacaaagacacttaactctgagccccaaatctagaggagagatctaaatgtcacgtgaagttcttaaaaacctttcttctgaggagttaacaagggatattaggaagattcctctgcccaaaagacctcccaaataacctctgccaactcaggctgcattaagttaaaccagatctgtctgtaaaatagaaatgagaatagctaataatatcaatatttcatacctttattttaactactcttctctggctactttgtgggttgtgagggaatggaacattttactgaggagccaggtgaatgaaagaagacatgcagagcaagaggtctttggtgagagggcctgtttgagcccctactcaagggaattaggagtagcatgagggccctgtatatccacagaggacattcatttttaatttcctctaagaaagaggaacaattaaaaataatgcttaagtatgtttttaaaaagacttttttttttttgaaagtcaaagagaaacgttgttagcctaaatttttatgtaaacatagaaggtgattttaaaaagccattaaggaggcaggggagaggtatgaaaaaatagattgaaggccacctactttacaattttgcctggtaacaccaaactaggcagccaaagcctggcttcaggtttgtcacagctatcggttatgataaacaatattaccatcacttcctggttgtagtctgcatgaatttgaaaactaaaatttgcagtgttcgggagtggtggctcatgcctgtaatcccagcactttgggaggctgagacaggtggatcacctgagatgaggagttcgagaccagcctggccaacatggtgaaaacccatctctactaaaaatacaaaacttagctgggcgtggtggcgcacacctgtaaacccagctactcgggagattgagttgggagaattgcttgaacccgggaggtggaggttgtagtgagccgagatcgtgccgccattacactccagccagggcaacaagaacgagactccgttttttaaaaaaaaaaaaaaattaaaattaaatttaaaaattaaaattaaataaaatttgcactattatgattcagtaaagcaggaatgttataattggttgttttctccttttttcctctgtaatactatttttaggaggatctaggtagatatctcactctgattattcccgaagtatgaagtctcccatactggctatttacatataacttaattcataagacttttaagaaatctctttttgccttctccttattctccagactggcattgtgaagatgagagccaacaaattatacctcaaagtctggaaaattagtcaactgttccacagttgtgcatgaaacatttctgactttgtgatttgtgaaagtagcactgactcagctaaggatcatggaaagagcatagacttagatcagaagactcattctagctggtaactgtgtgatcgtgatctgatcactaagactctgcgagccttaggagtctccccttgcatgaaatgaagttggtgaactagatgatcttcgcattatctcctaagttgtaaactcaatgattttgagtataggaattaacaaagccacttaaggggaaaaaagttcccttcatttcttgatgaaatacttattgagctatgtaccatattccatagaaaggaaaaactagatatcttaaccctactaagttgtttagtgaaaagaacatgaaaagttcagatgaaaagtcaagaagtcaacataggaaaaaacagataaactaataaactgaataagtaagtaatacagcttcaattaagtactggacttccaaatggatggaatcatacctttcagggctaaattgtatttgagaatacctactctgaggaataggtttttatgctctggaatcaacacctcaaaattcaacatttaattcatttcactcttcactcattactcttttgtttttgaatatacacatttttcttttttttttttttcctttttttactataagataaaccaaaaataaatggctaggtagatggctggagtttgcttgtttgttttaatgatagtataactgcatatagaaaagcaatatatgtgttcctatatgaacaacccaaaagaaaaataacttttaagtcatagaactttgaaggtctgcaaatagttgttgacttagttattactacgtgtattagtttgctagggcagttacaataaatgccatagacttggtggcttaagctggataaattaatttcctcaaaattctggaggctagaagtccaaaatcaaagagtcagcaggtttggtttcttctgagccctctgtccttggcccttctcactgtgccctaatgtgactatccctctgtctctatgctctgtgtactaaggacaccagtcagatttaacttaattactactttaaaggccctatctgtaaatactgttatattctgaggtactgcaggttaggacttcaacatatgtatttggggaagacacagttcagcccataatactgcatttatctttataataaggaagaaggatttatattattctactgttttgtgtgctgaatgtatttttaactttggttgtacaatttcccttacacctgcatcagcttatcacattgtgccaaggatgtgaaatgaattgcttcaaaatacaccctaattaattaaatattcacaacatttttatagcatttgatttttttccttgttaaacataacagagaattggatgttgttcacataccacagataagccaataaaccagacattttgtcatactctgtattgataagaatttttttggcatggaaatgatgtattttattgcctttaacttctaatacccccttaattacaaacataatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctacttaataactcactatcaggcttgatgtgataataaaataattcatgtaaagcactcagcacatacctggtttatactaaactcaacaatttctagttatatacatagatagacatacactagtacatgtgtatatatgtatatgtaccttgtatatgtatgtgcatatattaatatatgtatgtatgtattcatatacataatatgtatacatattcacattcattttcatattctccagcctccgtttggtacactacaacagtgtgtgtagttgaactaacagctggttctgctgtcatgatggctagaacagcaaagtcagccagagaaaccagcctcaaatggtacatctttctgtaagcagatatatatgatctatagcagcacgtccagtgattgcctcacagatactacttctaacctatgggggaatttttgcatagaaatccaaatcccctcctacctctcctctcagtgcttgagcaatctcttgatacatataaagctttgtaactatccttaagtttttctctggtctacatatggcctttatgcttaactcattgttaaattctcacaggacaaaggctacatacattccatatataacttcagcagcatctgctataagctttcccataccttatacactgaataaatcatgaaggctgatggaatcctgaaatgaacccataatccaataaaatgagaaaggctaaagacctaacctgctctggactcacattagtctagaagcttcaggaactcactgaaaggcaagatagaataatggttagtatatggactacagattcaggaatacctacatttgaatcctggctttgcaacttatataacttgggcaaattatttgacctctctgtgcctcattttcctcatctgtaaaatgataatcagattatatgtttcccaaggttatgaagaataagcttattcatatttgttatgtgcttagattagttcctggtacaaagtaagtgatagcacttactataagtgtgtactacataaataaaataaaataatgcctggtgtctcaacgctggcccacaaactagtctactctacacaggtcttccagaccaagagtgactataaacctaatagacatctctcaacaaggcagctgtaggtctttactgttcatgttgggttttgccagcagaccaagtgttatgaattggctttagccaagggtttcctgaagagattaaaaaaaaaaaaaaacaggctggtggaacatttggtatgtgtgtttctttagtggtttacagtctgtgtttctagtgtctgcatcattaatatatttctctttctggatttagaccctgtcattactcatctgtgtctgttttgacttaaacccatcactggaagaaagaaagaatatgggtctcaatgagttctattgcttcattatggtgataactttagtgcccacaaggaaatagttgcatacccactggctgcaaactaggtctgcattcttcaggaaagatgttatatggcagcctttaagaaatgcagtcttcttttaccttcaactttgtgtcttatttcactctacagtttttaagtgaaggagataagaagaaagagctagctgcaaaggtgagagttgaaatatttttacagagacatcattataatgaacatgatggactgtagttgtaaatagggtgagtgggagaaaacttgaagaaagttagaaacagatgaagaaaaggatttcagataaaaatcagggaaatcaatgtcagtatgggaaaaaagatagtaaggtagaaaaggaacttttaaatgaaaagaatgagtaaaagatgattttatactgattttaaataaaactctgtgtcaaagccttttgtaaataataaggttatagatgattgtcatggtggttatgtttgtttagcaaagactacattaatgaaatggctaagaagcaaaatcttaccaggttttaaatatgagtacactgtgtctattgctctaatttttgttacaaacttaccctaaaataggtcttttaggcaacaacagtaatagcgccaatcgcagttactctaccattctaccacagaccggggaacattctcatgaggactccagcattagatggcccattttagggcacaacacttcagccaaaactttggtagagaagcagtttcagtgagtcattcatgatcctaaatcttttggctgtggcctcaagatctcccctctgttcccagtgggaattatggtagagagacacagttaattgcctgtggattttatgactgtccccttccctgcagccggaatcatcatggaattaaacatgcagggaggttatcaagggactctctcttatgcggactgagaaacttaggttagaccctttgaagaattcactggactgaacatagagtctctactgagtaaaaggatctcctctgttaagttgttcatcatccatttatttattcattcaataaaaatgtattgggtgctgtatgagtttcctagagctgctgtaatatattaccacgaactgtgtgacttaaaacaacagaaatttattctctcacatttctggaggctagaagtttaaaatcaagttgtcagcaggcttgatttcttctgagggcgctgaaggagaatctgttccatgtctctctcctctctcctatcttctgttggttcccaacaaaccttggcattccttgcattccaatttctacccccattgtcacatggccttcttacctctgtgtgccctctgtgtctccaaatctctctcccctaatgacaccagtcactggattaaacttatttccaaatatggctacattcataggtaacaggggtcaggacttcaacatgtattttcgggggacacagttcaacccacaacaggtaccttttttgtaccaaatacaatcctaaatgctggggatagaaagatgaataatacgcggtctctgaactcaaaaacgtcatttaaataggggtagacataaatatacaattatagtgtcacaaatattaaattatatgtctcaacaaaatgctatgggaacacagaaaaacagggcaactaacattgtctcaggaagcccaaaatgtttcactgtgaagctgccttttgagttatagggtaaaggatattggagttcatcgattaattcatagttgtgagtatgcaaagggcattgcagaggaatggaaaaatatgtataaaaacatggtatcatgaaaagactttgtatctttcaagatagggaaggagttggtgtaactggagtctagggttagttgtagggagcggcagaatacatagaagagaataaacaggagatggtagacggcagaggacctgtacaatttcatctcaaagaattggggctttaggccaggcacggtggctcacacctgtaatcccagcactttgggaggccgaagtgggcagatcacctgaggtcaggagttcaagaccagcctggccaacatggtgaaaccccatctctaccaaaaatacaaaaattagctgggtgtggtggcaggtgcctgtaatcccagctactcgggaggctgaggcaggagaatcacttgaacctgggaggcggaggttgcagtgagcagagatcgtgccactgcactccagtctgggcaacaagagcgaaagaattggggctttataacatagaatgtctctgccaagactcttggggatgtgttttaatccttaaagtaacaataaatgtatttaagtagtagtataaaacgaagtgaaacagtagttaataaagcatcttgcaaatttggaaaggccattttgattttgagaaaattatttgaattatagaataattttaaggaaatgctttttaatttatttttaggatgcataggagctcaaactaagttaacaagattcagtcatccaaaccattgcctagtaggtgtccttaaggacccagtcttaataaacaaatacagctaaattataattggcatatcaactgtatgtaaattgaagcttataaagtacttgaggggatttgacaagtttgttctcttaagcattttaaatattactcatgttagttatactatttattatctatggggaaggagtttgctaaaccaaggtaaatgtcaatgctagttcctagacaactatcatgaattctgaattagtcactttttatttattcaacaaatatatattacttaacatctacgaacgagattatgtcctaagtagcaggaattcaaagacatgacaagggcacattcatgtcctcttataactcacagtctagttggggagaccaagatggaaacaaagaaacacattaaagtttgttgagttagataatggtggtgcatacagggtgcttgggtgaatgcagtggaagacccaactctttgttgaagaaggctttatatttagcttgcgaactttgaaggataaaaagtggttttcctagaggacaaagaaactggacagtgtagtgaggatccaagggatcaggcacaatgctttaaaaagttaggagaaatgaaggctaagccaaagtcccagaactgcaaaaaattaagtccgtgtggttttggttaggatgagaggaggcaaggtaggagatgaggctggggggttggccagcagccagtaaggggtctcatacaaaggagttagaacttttatatgatgtacgatccactgatttaagcagaagagggccatgatgaaattgggttttagaaagagacctctgggaacaatttggaagaagaaattagagcagtggttttcaaacatttctctttttttttaacacagagaaaacttttctaaagaaaatcttacatctaaccaagatagataaaataagagtgatatttctttcaaataaatattatgcaaatgaaaacaggctacttcaaactcaaaagtgtcaaattgggggttatagactacagcacctgtgttatattagactcagtatcaaaattatatctgtacacagttagttaggaattatgatggttcaactatttttcaactttacaatggtgtgaaagcactatgcattcaagtagaaattgtacatctctcatcatgctgggtagcaacattgaggcttagctcccaatcagctacacattttcagcttctgttgggtttatcagggcgtaaccccattgtaagtcaaggagcatctgtatttattaccgtactatattgagacaattctgattttctgtaataagttgtaaacaataacggttcaaatgactctccctgtcatgtcatgaaacccttcagttgcattggtctagaaatataaaacagtccgggtcgggcatggtagctcattcctgtaatcccagcactttgggaggccaaggcaggtggatcataaggccaagagatcaagaccatcctggccaacacggtgaaaccctgtctctactaaaaacacaaaaattagctgggcgtggtggtgcgcgcctgtagacccagctactcgggaggctgaggcagaaaaatcgcttgaatccaggaggcggaggttacagtgagctgagatcatgccactgcgctccagcctggcgactgagtgagactccgtctcaaaaaaaaaaaaaaaaagtctgatagtgggaaaaaatccctaacaagagtcaccacaactcacagtctttactgtaaatataggcattcaaaactttcttaaaatgctaaaagcattcatagtgtagtcttacatgtctattttatgtgttcacttttcgtttctacgtacacggtagacatggtaaatatctgttgaattaaaatgatcaaaaacaaagtaaagatttaaccaaaaaaatacagacaatataaaaccatgaagattcaaagtcaaaagtagctatagtctctagcaaggcagatgttcactggcatttgtcctctggtctgacttccagccccaatttatataatcctgacctaccagaaattgggataggtatcacttcatggaaaaagacatcatgctttaagaaagaagagacacatataaacttgtatggggttagaggagctatgtccctctctagttccattagaaattgctgttaagaagggttgggagcaaacctcttccaatcctacccacgtctcaaggcctagatcaaatttcacggtctctgtgtgacacactgatatctcaacacttcctgaaggtgacccatatgccaggaacagcactagatccagagatacaagtattaaaaagatccctgccacctctcatctacatttctagcatctgtttttactcatttgccatttgatcatttcccatctgtatacaagactttaaggcccatgagagcaaagtttctgtaagtttaattcaacctactttttttggccacaagctttgtggcaggcgccatgttaggtattaagaaatacaaagatatagaatacaagtcctccagtagcttgcagtataccatgtataaacctcagatggctactaccgtatacccctcaacagccagttagctgtgagagtaaattgtaaattctttcatgctctggccagatttaaaaacatattaatgtgtatattcttttccaactgtgtcttcttttttttttagatggagtttcactcttgtcacccaggctggagtgcaatggctcagtctcggctcactgcagcctctacctcctgggtacaagctattctcctgcctcagcctcctgagtagctgggattacaggcacccgctaccaggcccagctagtttttgtatttttagtagagacgaggtttcgccatgttggccaggctggtcttcaactcctgacctcaggtgatccgcctgcctcggcctcccaaagtgctgggattataggcgtgagccaccgtgcccagcccaaatgtgtcattttagatttcactttcttcttgagaccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaatgtaaaatgaaaagaaggctattgcctctgtgctgattgttaagatggcattggaaacatttttgtttttactatggatatagtcataaaaccatgaatatttttcaaaggatcacagtatgaaatacagagccaacggtagaatatattaaattagcccatttgaaagagggtctatctgtaaataaaccttgcagttaagaaagccaattatgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcattccagctgagtcaagatcccgccactgcactccagcctgggtgacagagcaagactccctctcaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcatatctgagaaaactagaaatctattttatttatcttgtaatctgaaaagggagtgttataaaaattaataaggtttcctagagtaggaaataaaaattttaaaaatgaagtaatgataaacattaggctctttaaatatatacgaggcatatagaattacaaatcaacctggagagaccaattggagggaatgatgacaatgaaagtagatgcattttaggatgtttggcagattaatccttcagttttatcccttcagaggtatgagaggtcagtagcatgtctaaatgtaggcttatgttatttacttttcatcatcactgtgaggaagggtgaattttttaataaaaagaaaaaaactatcatagcatggagcttgctttttttaattggcagataattttacacttaatatttctctctcagctccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaaaaaaaaaattagctcaggaaggtgttgtaatcacaatggtccacactctgcagatcagtctcaggaaagagattggcatcctaacagaagacattctacttccttagtacaagattagggtcctccagacaggatgaattattgcaagtaattctgattgctgcttctgtttaaaaacaggctgctgcatcaggctagagaaggccctttgtaatgaagtaaaaatgggtgaaaattccctgttatgaaagaccaaaacaattagtgctcttctcttggaaaatataatagttgagtgagaagcttcaaagagctgcctggcccttccactccttttgccatgtgaggacacaatgttcatccattctacagtgtaaggatgcagaggctatgctcagtgtttttgaaatcaagaaatcataaacatttggataggataaatgcaaacctatttaccaaacccaagcatgttgaaaccttaatctgttcaggctgctctacctgagactgggtaatttgtaaacgacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgtaataaatatggtggataaggtgagcccacattttcctaataaaactttaaaaaagttttatgaccattttgagtgtagctggacttttagaaatgtagacgaaacagtgaaatgtgtagttatgaaatttaatttgtttagttatacagatatattcaaattgtagatgatgcagaataatctcttcaggtatgatactttgcttttcctccccactatctcattttgtaaaacaattctattgaaacttcacgcgtatctctgacattggtgtttctagaagcactggagctaatttttgtgtcatctaacagttttccagagcatattacattcatgtccacctaagtttttagagatacaacactttaatctgtgtatcagagtatcaatgtcaggctttttccgcaagccacaaatactcatttgcataccactaggtccattggcttttccattcatcttgcatgtgtatattggtgatcttcgttaggtatttactgcagggaaatcttaagtaatctttcaaaggcttgtttacaatgatctccaacacttagtactatgacgtcacaccctgtaaacaattaataggtctgtgttaaatttcattatcttaactgccttccccaattttgtacgtttacatcataagcatctaaaacccatattaagttgttccagactaatgcgtgttttccagagagtacattattaagaataatttggaaaatgtcccttggaattaagcacttgaatgtaagacatcttcctctttttttctgcgagataacttgtagggagcaacgggaaggtatgctttatatttgtgaggataggaatagagattttcttgaaatatttatccaattatatgactttaaaatcatgcaagtttcttatttttattcatcgtatatatgtattaaatgccaggatgatccaaacacatagaaggtgaagttcctgccattataggaatttttggaccttagagaatatccaattccagaacaatgcatggaatactttgtggaaagcatttgcagagagaaagctgtgagttgcagcccttgtcctcaacaactgacagcaaatttgtcaacaaatttaattatgtttatatcaggcagaatgtgtttgaagggcctgcacacgtttcacatagggaaaagaaagaggtgaagagagaaatgttacatgtaaaaaattttacatagtaaatcatcacatggaaaaacacatttttcactggcaagtaaagaaatacaacaacaaagtaacaggtagcgacatatatgtattgtgatggctaagcactaagtgaggtgttggagaagctgtagagaaacaggtacaatttcaaggtggtgccgttaggtgacaattcatggaaatgtatacataaaacaatgttaagtgaaagaattagatcacaaaagagtatataaacgctgattatatctataataatgtgtgtatgttgacatctattgaaagaggatttgaaagaatgtaagtttaatgttgatttgaattttctctctgtaacagtgatttaaatgcatactaatttgaaaagaatacaatgaaaaatgactccccatcacacccctaaaacacataataactacacacatcttggtaaatagattgtggtagaatatgatgttcattgtttgtgatgttgcaacattatctataaatcaaggacttaattgaagttgtacttcccttctttatctactgtaagtctgatgaagcattttttgatcactgtttattatagtaatgagaaaagaataaatcttttccttataaatcctgacaatctgcattttaaatccttgcacaacctgaattctttgtctccactaaatgaatacagaaagtttaagcctgtgattgccttatttattctgcctccctacctttcaatagctactcaatagctctttcttgacctttacctgtcagttaatagttggtacattgagatgtgtttattaagtccaggcagctaagattcagatttatatgcagctaatatgctgaatgaactgaagatctactatgtaccacagatctttgcctggtactctacaaaggggacttcacttgatcttggtagtaaccatctgaagtctgaactattatccctattctgatgtgacaaaactaagcatcagttcagcaggcagtcctcttccgagcccaggacagtggtccttcccttgttccattgtgccttttaagtggctagtctcagtgtgttatagagaatagtatagttttaaacatataaaataaatttgtaggaagcagcatatttttaaggaagatctttttaaaaagacaagtgtgttgcttttttcctcatttaaaaaactgtatattgttgctataaaatttatttataagagtggttggagggaggccgaggtgggcagatcacctgaggttgggagttcgagacaagcgtgaccaacatggtgaaaccccatctctactaaaaagtacaaaaattagccgggcatggtggtgcgtgcctgtaatcccagctactcaggaggctgaggcaggagaatcgcttgaacctgggaggcggaggttgcaatgagtggagattgcgccattgcatgccagcctgggcgacagaacgagactccatctcaaaaaaaaaaaaaaaaaaaaaaaagagtggttggaaattttgatacaaagcaattcaaaattatacaaacaatttgagtagaatccaaacatgaagcaagattttctactactttaataatttcaattaaataaaagttaggagctgataaaaccgtttgagggtttatttaaaggggagcatgttattggcatgctgaccaataacactgggaatgtaatgtatcatgacatgtcagataacacaaacaaggacagtttttggaaaatcataaataacaaaatagaaggagtgtaaaatggaagaagcatcaaggggtggttggtacaataagatattaactctgagaaagttttctaactcatcacttaacattatgaatactgaattgggatgaccacaatactagcttctgtatgactccttaaatattgatattggaaatgtgcaccacatgataaccaatattttaaggtgggggcaaaatagctgctggtatgaatctctagaaagattaacttgaaaactgtcttgtgtaacaaaaggaaaggagaacatctgggaggagaaaggaaatttcctagaaatgggaaatgtggccataatgtgatttctttctataacccatgtatgcaaaaacatttatctccttttactctagtcacactatgtttgtggcttgcatgagtaagaaagctagatgaggagataattgttcagcaaaagaattatagagttgaaatcagtgaagtgaatggtattttatagcaaagagatccctaaaagtaggtggcataaagaatagatgcaaaaaagtattgctttctcttcgagttctaaagacctctgttgatgacgttttgctcatttaaattccagagaataattggaaacagagactttatgcgacagagctttcatttaacttgttcacctgacagttggctttgaatgatattttattaccaatcaacctaaattaaaatacccagctcactgtaaaaccctgcagacagtgtctggaatgctaaaacacataccatatataaataaaattaaggtaaggacaaagattgacaaaagcaatgacagtgaacattaacatgatatcagcagctttgagcttctatcaacaatgtggaccatgatgaagttaccagagagggcagtatagatggattttctaacttgcatttatcagaagagattttcacttttcaatcttaactatgtcttataccttttaataaagatgtggtatcaaacatcgaacatatatgtctgtacctacatgtaaatatatatgcatgtgtgtatatgcatagccatagctatccatccatccatcccaaagttcatctctccaaggtgctagtccacataattgcgttcagttcttctctggtctttgtataaatgtgtacttaaggactttgtggatagtgcgtgatataaatatggttcaggcccatcaaaatgcagattataggatccggtgaacttttccttaccaaataactgaattcctgaatgttgtattattataaaattacaaaagtttcaaacttactgctattctctaattacttctatagagtgattattatatgggatcaccagatgatcatggtctgtcatgctattgctatctttcttcataaatatataatttatcaaagcttaattatattattatccaataaatgaatgatagaataattatggttatgtggttcattacgttatgtcccattctctgactgaagcctctcagtttcatatctttgttgtgtagactatttatgacaagttaaatctgttctctggaacttagtgtcatcgtctattaaaatgaagggttggatttcaattaaataattcataaatttcctgtcagctctaaaattctatgttccattgattatcctcaaactattatacaagttcataaggccttctaatatatatatatatatatatatatatatatatatatatatatatatattagaagatagatagatagatagatagatagatagatagatatactagaaggccttatgattagaaggccatatgtgtatatgtatatatacacacacacacatatatatatgtatgtatagtgttcagttcttctctggtctttgtataaatatgttttatatatatattttaaaacactatattaatgtgcatgaattgagaactgctgtggtatctaaactcctttctgcttgactctatgatgagagatgaatgaatttggaaatatttagtccaagaaaagaaaaagtgtggggataatcagtcttcaggtttatgatgaattgtgactagctttcactctcttgtaaatgatagacaaagagagaacaaactgtaccaaatctcagaatgcataatgtgatagtgcattaaaaaatgctgtagaagctggagatacttagggaaggtagtcatttgatgcaaaatatcagttaatctcctctctagtgtgctttaaagccagggaatctaaaatgggggaagccaaggaggagtagagttgtttctcactgttcaacaggaaggcactttatgtattttcttatatattaattatttctgagctatttctcctaagagaaaacccttagatttggcctacagaagatgtacttatcattggcctttaatgatacagacattgccattgctaccaaagttagtttatatgtacaaggttatatttaattagcttatgtagatcaaaatgcaaggacagaacctaatccctcctcttcctctgtactaatcaatttataatctgaatgtgtcagaattcagattatgaattatgttgtatctattaatccttgtaaccacagcacattttataaaaatatacatactttgattctaaatgataatatagtgcacgttcaaaaccgagtaagtcacagttggtgggcacagagacattggtaataatgggatcctccagctagcaccaagtctctgttttttctttaatgttatatgatgaaggtaataataggtggccagtaaggataaaaagccacccaagaaagaaccagtcttaaacttggctcttttgcttttttcaagttttctcataatatattcaattccatgtaaatattgcaaacagctgaattgcacacattaacctaaacatgaataaaaaatgttgatattttatttaacctaaaaatagtagttatggataggctgcttttatgattatcgtctttaaaatatatcattttacattgggaatatagggaggattgtcaccgttattgtataataagaaaatttgttttgagtacattaaaaatacagtagatgattattgcaatataaggggaaaagttgtttgcttttgacagtctgtcagatgtagcctaggaagacaagtatggtagctgctttatataaaacagtaggagaaggacacaagctcaaagaaattttacctagctgctgttattaaagaaattcttttatagaatagaggctggttttttttttcatctttccgtttttgcttccatctctgaatcctttgctttcatatggcatgcaaagcgtctgtgcatggcagcctgtaacttctgttatttaaactgccaactgttaaaatggattgagttgaaccagaggaggaaaatagccccactgaggcaaatgcatttttacacccttctttaataaaatattgtaaggtatagctagaaagtttccccttggactttcatctaaaactgttagattgtagctttgtgaaagaatcattgttgactcctgtcagacagttttggagaggaggtgaagaggcttgtcttctgactttctgtgcactttgtcaaatcaggtactttgagcagaagtacgaagtgaaggctgatgtcagagaatgccttgaagcaggaacttgtgctagtctcctgtgacttcctttttttttttttttaaggaatcagattggattgtaaaatgatgggaatatgactggacataaacacgttcattgcaggctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagttgaagcaaaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggttaataaagatactctcaagcatttgccacctggaagcaataatatgagatgattaaactcactggatagtttggggagagggggagtttggttaatctatgcaaccaactagaaatgaagttcacttaaccctttttcttcataaaataaaatggtatcaaggtatcaagcatgtttttttggggtttttttgtttttttttttgtttttttttgaggtggagtttcactcttattgcccaggctggagtgcaatggtgcgatcttggctcactgcaacctctgcctcctgggttcaagcgattctccagcctcagcctcccaagtagatgggattataggtgaccgccaccacaccctgctactttctgtattttcagtacagacagggtttcaccatgttggccaggctggtctcgaactcctgacctcaggtgatccacccacctcggcctcccaaagtgctggaattacaggcatgagccaccgtgcccggccatcaagcatgattttggttattgaagtagaaagtagcaattaagcattgtgtagtaatgcactgtttcatttctcctgtgtcactatatgactgtaacaacaaactgactgcctttgattctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaacttggttacctccataaagaccctatctccaaataaggttacctcattctgctgtactggagcttcagagatccaatatatgaattaagggggacacaatttaacttataagatggctctaatcatcaaagttaggatatataaaaaggagggaataggatgaaaggaaatgaaatcagtttaatttggatctgcagtgtgaggtagctttggaacaatcaggagaaatattgagaaggtgattgaagctgtagcttagagcctgagaaatgcagagttgagatccattagcatgcaggagatagaatagttagagcagttaagtttggcaattggatgagcatacccctgggaagtagctcatggaaagtatagagttaaaatatgggaaagggcaaagaataaagtgctgaaaattactaacacgttgtgaccaaaccaaactgtgtctgtctgcacacaagcaatggaaagccaaacaccaaagcactgtgtttttgcagtgagaaagtttattgccaggcagccaagcaaggcgataggagtcaggttcaaagctgtctcccatactagccttgcagccatggatggatttaagggagagattttgaggctgggatctgggggctggacagtgattgactgtaaggaaaagggggttggaaattcccttgggcatgagctattgaccatgcacgcttcttcatgggtcttatgttcagaaaatgatctgagggtggagattttggccctctgacatcaaaaggtcactcaccaggcaagcaagtctattctgtgcagactgcagtcagacacattaatgggttccaacttgtcccagactgtaagccagttttgttgcaaactaagggaattgtaacaaagtgttttgttctctgttctcctgcaagacaagctcaagaaattttgctacttaccaaattctcaaggaaaaggatagtagcatagaaacagagaaagattaaagaaataatttgagaatgaagaaagaataataatatacaagctaaaagaaaagagagtttcatggaaagaataattgtcaacagtgtcatgtgctacagagaggtcaaggaaaatgaagactgaaagaaaaaaatgttaatactgactgcagaatgtgatattgattcaggataggccaattcataaacaaagtaatcatggaacataccctgtattttcaatagaatttcactctacttgttactagagaaaagaatgaatttatttatatagtataaaatttttatacttataaaaattatattttttctagatcatgtagtttttctaatccataagaaagtcatatctcctattttactgtctttcaaaaggtagttaaataatcctgacaaagggaatcgtttagaaacaatacatacaaattctgccttggtcttgaaattttgatatttatggttatggtattttgcgactaatgttcagaataggataaaatagggcatctcagaataagattataatgtggttggtcagaagaaagtcttctaaggaagtatctttcacttcaagtcattgtctgttttttatgtagttaatgctggagctctcagggctgctaaatgtcattttatgtactacttcacaatctaaccatacatattaaccttttccttcaacacccctaagaacagaaagctgtctctagaaccagctttaaagattcacagttagacccagagtaaaagaacagattgaaaagatagtttgtaaactatttattgtcctgcacgaatatgtatatatgggaacaaatgacatatttctatgtctataaatccttgtaaaagttttattcagagaaagaatcagcatgtatttactacatggctatttaatatcgagaaagctaataaagaggtagaagaggctcattctctgccatcccagaactctcctcttagaaaggcaatatctgaaatgatagtgagcagtacgaaattggctataattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgagtgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcacatgagtaggttgcgaaatttttctcccattttgtaggttgcctgttcactctgatggtagtttcttttgctgtgcagaatctctttagtttaattagatgccatttgtcaattttgtcttttgttgccattgcttttggtgttttagacatgaagtccttgcccatgcctatgtcctgaatggtaatgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagataggcggcgttatttctgagggctctgttctgttccattgatctatatctctgttttggtaccagtaccatgctgttttggttactgtagccttgtagtatagtttgaagtcaggtagtgtgttgcctccagctttgttcttttggcttaggattgtcttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctaaccatgagcatggaatgttcttccatttgtttgtatcctcttttatttccttgagcagcggtttgtagttctccttgaagaggtccttcacatcccttgtaagttggattcctagctattttcttctctttgaggcaattgtgaatgggagttcactcatgatttggctctctgtttgtctgttgttggtgtataggaatgcttgtgatttttgcacattgattttgtatcctgagactttgctgaagttgcctgtcagcttaaggagattttgagctgagacagtggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatactggcctcataaaatgagttagggaggattccctctttttctattgattggaatagtttcagaaggaatggtaccagttcctccttgtacctctggtagaattcggctgtgaatccatctgatcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgcgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttctttaagaatgttgaatactggcccccactctcttctggcttgtagggtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcatttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacatagttctcgagctttggtcttcagctccatcagctcctttaagcacttctctgtattggttattctagttatacattcttctaaatttttttcaaagttttcaacttctttgcctttggtttgaatatcctcccgtagctcagagtaatttgatcgtctgaagtcttcttctctcagctcgtcgaagtcattctctgtccagctttgttctgctgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcccgttctcagatctccagctgcatgttgggagaaccactgctttcttcaaagctgtcagactgggatatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcgagactcggtggggtagggccctccgagccaggtgcgggatataatctcgtggtgcgccattttttaagcccttcggaaaagcgcagtattcgggtgggagtgacccgattttccaggtgccgtccgtcacccctttctttgattaggaaagggagctccctgaccccttgggcttcccgagtgaggcaatgcctcgccctgctttggctcgcgcacggtgcgtgcacccactgacctgcgcccactgtctggcactccctagtgagatgaacccggtacctcagatggaaatgcagaaatcacctgtgttctgcgtcgctcaggctgggagctgtagaccggagctgttcatattcggccatcttcgagaagactgttttcaaagctggattagagattgactagaaaggaagaaagcctgagtatagtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtagagagcaactctcaaattccagttttaataggatgtctgctccagaaccttgtaaagttgtgttgctcacatgaagagaaggctaggattggaatataacatgggtatttaatccatttactgctggaatcaggaagcaaaaaagtattcagtacatatttaccactcaatttttagatagtgaacaattgcaagttggtccacaaggattacatccgtataatacaactgatcatgtcctgaagacggtactgactgttatgtcacagttctcatatgtccagcttgcctagactgttgtgtgaaagagcattgcaccctgtgatgactcaagtctctgaaaaattttctctcttcaaattatcatgaaaccttcattagtacagtgcacaataatgttgcttggcttttacgtaatataaaagcaaatatatataagcctttttgtatatcagtgatcagtacactagtcactcataaggtgatgatgcagggtatccttatgtaaacactttttactgtaccataaagtgaaaacacaaaactgtaaatataccctgttttaagaaataatgccctagtgagctccactgactttttttttttttttttaatgaaattggctgcaacattgggaattacatcatgtaattaatatctttgttacattgggctcttttagaacagaaacttactctggaccccttaagaaacaaaatgaattttacttccttctgtgtgtctgttcttttctatttatctttcaactggcttactgccctattgagtagtgcctttcatcacaaatcatgccatgtgttacctatgaattggctgcccctgaaggaaactgatgtccataatggtcccttcattggccactgttgagggggaaaaagcctatttagtactgctttcctaagtaaaaaaaaaaaaaaactattgagggtgatggtttcagctagaagtggtgttgggtacatcgggcacaatgacctgaggcaactgtttgcactctaagaaaatatcacccctttcagggtcatgggaaatccaagtgtaagttatattcattgcctccacttactcctcaaccttctgcaatctggcttctgctccccttatttcgaactgaaattgctctcattaaggtctctaatgacctccatatttctaaatctgatagtttgtctttattttactgcatctttctacaacatatgatattattgcttattccatttttcaaaatatctactcccctgaattccataacgtgtactgtaatggttctttctatgcctctctgaatatttgctgttttgtttcatggactcttcttcctatacttatctcttaaatgtcactgtttcccaggatttgatcattagcccactgcttttctcactttacgtacattcctgaatgatggctttgataaccatctaccatctattacccaaatctctctcactcttttcaggcctctcccctgaaccttggtcttgtaatatttgtaacggcctgctgggcaggtccactcagatgttttaaaggcatacaaattgacaaatccctaactgaactcatcatcacctggaatgcacctttttctcctatatattcttagatgatggaaccaccattctcccaaacatataggctggaaattttagagtgatcttggactccttttctttaattttagagtgatcttggactccttttctttcctacatgtccaatgaatccctaattattgtcttgtgcttattaagttcacctactgcatgatcaccaaactgaactgtcttaccacttcactccctattgcatatctgaagttcaagagccttaaaatgacacataagcccaatctgtgttctaaccatcatcccctgcttttaatcaatactgattttgtttgtcatcttcacacacactttttttacctcatattttctcttcctttcctcacagcatctccttttcctggaatatacttttcttccaggataattcatccatatcctttaagaatctacaacaatattgccttctctagaaagtcttcccaaagatgcttcccctaaggcttggctgagtatttaatttctgtactcctgaacagtatacccctcatcatagcacacactataactctcttctcattatctttgtatgctaaccgcatttgagagagaacaccatgaggcaaagggctgagacatttcattttggtatcaggggatccaatataatctaagttctcaaactgactcactgagaactatataacagagtaaagagaaagccttaatacatttccattagactaatttttaaaccaaaatgccacaatcactacatagtacctgccttgaaagactggctcatttatctctgtatccctctagcactgtgccaggcacatagtcaatgttcaagaaaagatggttgaaataaattgcaggccagtttttggacagagggaaatatgcctgacattggaacagactctgcttatgacagcaaggctcctcctctttcgagtgcataagtctactcaggaaaccgaattgaatttcagcaggttgcctggtaaatctgctgtcctagaaaaaaaaaaaaaaatgagtgaccggttttgctagatgcatcattcaagccaggctggaatctctagaaataatctctttctaccctaaaggacaaatctgtccagacaactggaatcctaaagcagcgaagtaatagaaagcagtctggcaacatttctatacccactggatgacaataagaaaaataagtaaatagttatgaaagattttcattgcttctcaagggcataaaaaaaataccctcgcctatgatgacttgtgaaatagagttagaaccttgataaattctgacttctggctgatctttttaagtctttgttttaataggctaatctgaaaaatacttctataaacatctgtttgcatctaatctcattgtcccaaaagtgactaaaaaatgtcatagtaccataatgaggctgtctagactttgaaaagtgtaatatgatcgtgatgctaaaatctttggaatttggctctcacaatatctaatatttaaaatgttcagctttttctctgtatcgggtgccattctggtcattttactttattgtttcattactaaagtctttgtaactgccctgttaggtgggtctttaatattatttttatgttcacaaggggaaattaaaatgagaaaaacatagctcttaagtggcagaacaaagatgtgaacccatatgtatggccatacactgagaactttgacctgtcacgctaaattgtgactatccattgtaagtagaaacagttttttgcttgaggcttgtttattgatttgtgtgcatgctcttcacatccatcagaagattagtatgggccaggtactagattacctcatttagttctgttaatactcttcagtgtaagtaccattattatccccatcttacgaataaggaaactgctgtttagaaaggttcattttgcgaatgcataaacgcaaagtgggcctaattggttaggaaacaaatgagtctagtagtctacattaataagttcaaagactacacatagcagttagctttactttgctccattgttataagtggtaagaaagaatataatgcttagtgctaagacttccctttccaccccacactgcctgcactaggaagggaaaattaacccggaatgcatgctttactaaacatcggtcagtaccttttaccatcaaaggacagactttttttttttttgaagtctcatgtgatttttatcattgaagtaaaactctctccaggtgatgtaatgacatacctcctattttttctggatttttacccatctgtttggagagagtcaatcttttagagagaatgactttttaagactttaacttttagaatttataatctaagatacgtgaaatacctttataaatgataactgtgtggacacaaatttattcatgttctaaaatttgtaagccatgactttcccatcagggaacattccacggcccttactgaaacagggcagaaaactggcacctgttttatatcctttttttctttccattatagtatacttagtgatggtataatcaacaaggaattagtttagagattattggatcctatgctactctttcttaaaattgaaaacaatatgtactttgtagctaaagactgagaatttaacatcctatctagattttgttctctagtttgacaaattaatcatgctcaatgccaaaaattcagatattatagaaatatatatatatatatatatatatatatataaaagaatcagatggttgcggtggctcatgcctgtaatcctagcactttgggaggctgaggtgggtggctcacctgaggtcaagagttcaagaccaacctggccaacatggtgaaaccccatctctactaaaatacaaaaattagctgggcatgatgacgggtgcctgtaatcccagctactcgggaggctgaaacagaagaatcgcttgaacccaggagacggtggttgcagtgagccaagctcgcaccactgcactccagcctgcacggccgagagagactccatctcaaaaaaaaaaaaaaaaaaaaaagagtcatcccaccattcatagatagccactattttttattggtgtatatccctctaaactttaaaaattataatattataaattatatttttttcaaaaagcagattatgacatactcttataacttgcctttttcaccttatcatatggacctctttttatcaagtacatgtagatctatgtaatagtttagattgactgcatagtatcccaatgtttgtaggttccctgttttgtctaatcccatgatggacatattggttatttatgatattcattagtataaacaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggatatctaggcttcaacaatagaacctcttcggaagatttcagagagcccatttctgctcactttttaaagcagaactcctgttttctatgtaaatgcttcaagactgtttttttaaaaaaatagaattaaaattaaaattacatgtttattgaaacagctgtcactgtcttagttctaataactacaagtccagtcagtatattttatttcattattttcttccttagaaaataaaggttaaatatgtatagacattctggttcttcctttatacattcattgcttttcataccctctttgcaaataggaaacatttagtcattaaatagcaatattcgagaactagaattccctttttctgctaatcaaaaattaacagctatctttctgtttcttcttgttgaaatccccctatcttttaaggcttaactgggaagaagttgtccctgactcccagctcctgtactcaagggatatgatttttctccactttgaacctccattgtacttaaaatgtaatagatgctacaagagacaatatagttagtttcatgttctagttgttggtacatttatcctttctaccctcataatgtgcaagggtgcctgttaaggtaccctgcagatagcttatgcagtaacaacgtgtggatagacagacagaagaaagcctttcctttccttgtattaatgtcaaaatacattccctctgtgaaagcagcagagctgaaggtgaattcaaggatcagtttctgatttgatgctaatgattggatgattatttaatcaacagacaagtttctagaaactactatgtataagccactatcatagacaccttgagcatctctgttgtagtttgtgtggtttctgttagcttgctcttcaatatgtttcacatatataacttccttggaagctttaccagctattgcctaactttcttcatatatttatttgtcacctttttctgtattttctagatatgcaggcatcctcatcagactttgaacatcatagagagaaaatctgtcttacgacccaattgcattctctagtaaagaagcaaacataatgcatggctcatatacaaaaccaaggacatttaaaaaaatctattcactagctttgacattgagtccaaagataatcaatggcaaggtctgtggcagttgaaatactgaacaatatactgatgtaattttttcttaaccatacttttctaagatttcttgaaatgcccatgttatcaattatgtaaatgccagtcattcagaatcccaagagattggctgtacatgttataaaaatatcatgtttatggtagataaaagtaagtattgcatattttctacatttgtagtttaatgtggatacatttttaatgccttgaattaatattattgtactatgtgattttacttttatcaggtatttcaatcttcctaaagttactataattgagtttgtttgataatgtacctttacattagtacgagacttgatagtttgcaaaatatgaggttcataatagagatggagagtagagttactacctggcagggaggataagaagaaagtgaaatatagaaaagtgatttaatctcactactgcagttttgtaaaatctaatttgtttttcccctagcacagcagagtttcatgttgataacaagctactgaattaataaatccattgcaactattgagatttttcctttaataacataacgaatgctgagcattaagaaaaggaaaggcgttctttgcacagaagttacctctagcagatctacatccctatgcataggaacaataccaacatcataccgtgaacaatatcaatgtgaaagtaatttgtgcatctcaattagaatactgtattttctacacaaaagcactctgtttcatggaacacatttgcttattttccaattggaaagacatttgggggtctattttgttatcattacatgtgcttaactccaattacagttaatgggagtcgtgtgtctatagtcacagtagcctctgaactattttaacattattgctttccattaccatcctcgttaaaataactttcatctcttctaccaacctgaactaccacagtaatctaggtttctgttttctttgcacggatttatttgcatgtaatgaaggatacagattacacaacatgacctgtttctagtttgcacattataatgtcattgagattagaataggtctagaactatttaattgctaagtggaggtaatcgattggcttctagacgagtacccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagttgaatgtttgtcacatgtctctggctagagaaggactttctaagcttaaaaacaaagaaacaaatcacagtgtaaaagattgatagatttagtttcataaaaacagcaaaaaatgaaaccatatattcctaaaaacctacaacacaaaataaataacaatcaacaagcaatcaacaaacaaaggaaaatatttctaataaatatttcaattgtttagtatccctaacatgtaccatttaaaataaaaacaaaagcagaaacctaagatcccaatagataaatgggcaaaagacatgatcagtatagaaaggaagacatatgaaacgttccacctaattagtatttgaataaatgcaaaaagaatgaatcagatgcaattttttcactttttatattagcacatttttaaaaagattaatacctaacaaagagataagatacacaaattcatatactgccaattggatttaaattaatacaactattctggaatacatttggacttacttttgcataccctaacaatgccacttctacatatggcatatgtaaagatgtaactgtcatgttccagaagtttaatgacatggaaaatttctacaatacaatattaaatgaaaaggtagaacaccaaactgcatatgtagtttgagctcagtatatatatatatatacgtacacatacacaaaagacactattctggtcacagtgaggagaaagaatctggtcaactagtagagcaattggctgtcccccacaaagagattaggctcaagcctaatttggctgccaccttgcagtcatttctggtgagtaaaaaactatttccaagtcaggatttctaaaatcacagagaaaagcataaataaaaccattttggacacaagggggaaaaaatgtaagtccatatgagatgatttcagtataacagtccaaaataaatcatctttctctcatcagtgcttgggatgcaaatagctactctatggacatttttggaagcaacataaaaagttttcttggtttccttagcctaagctgcaatagacccagacctctacttgctctctttgccagaaacaatgcctgaccactgatggtaaatctgccacattgtcactttcaaagggctttggagaaagcaaagctcattgtaaattacagagggtttcttttactttgttttctagcctactaattggcattaaaatgggatattttgtaacactatgtatataagggtcatagacttcgtttatgttatcctgctgtgagggactagtatataatgttaggtcaacactggtatctctacatgcctatgaagcaccatagggaaagaaacagccttcccctaggcaacaacagatggacgcctaaccttgtggggaatgaataatggacgtggcccttttataacagtttttttcaatcccaagtttaccgcctcatgccatattcaagatacagccttgtacttttggcactcgctcactgtgttagaggattgtttgcacactcccaggttacataatgcagctcgagtcctccagtctatctcatgtcacattgtgtttaagctttatctgtattgtgcttattccccagttatttcacttgacaaagtcttcggtaagaaggaaattaatgatgtagatttaggtgtggatctgaaactttgtgacatccaggtattttgtggatgatgtgctttgtacatagttgctgaataaatgattgcatgaatgaattctgaagcaatactataatgggtttagtccatttactgcaggactcagttaagaaggttttgagatgaatgccaaatcaatttatgcttagaaaaggcataaagcttcttactcatatgacagcagggaaagccttgacatctgtttgagctggttaacctgatattcagaagctgcagaaccatgtttaagctgggccatggttttatattcctttttagtgaaagatttgaatattacttttgttttggccacgctttctccataggatgcacattttcttttctttctttctttttcctctctttctttctttctttctctttctttcttttctctttcttcctttttcttttctttttcttttttcttttttgagacagagtttcactcttgttgcccaggctggcaatggcacgatctctgctcaccacaacctctgcctcccagatttaagtgattctcctgcctcagcctcccgagtagctgggattacaggcatgcgccaccatgcccggctaattttgtatttttagtagagatggggtttctccatgttggtcaggctggtctcaaactcccgacctcaggtgatctgcccacctcggccacccaaagtgctgggattacaggcgtgagccaccgcgcctgacccaggatgcacattttcatataactatgttcctgtcttcaaccttatgctttaaccaggtcactcttcatagtatcagaatctattcaccttcacatggggcacatttcaaagcctttgatgaacaaaaagaatctgttagcgcatgcatagccggctctggtagatttggaaggtccattttgggattgatttctcaggcttattgctgcattaaggctcatgtttacaaacattagaatcccttaatgaattcttagaccataatgtgttagtctatgaattaagaaaaatgaagcagatgaagaatatgacaaatcatgttaccccatcctccaatcaagcgtgtttttctgtatttcattgcacaatgtccccaacaagcatatatacacagacagaccctcctcttccatttttctctctttgatttccaaaaagataacaggcagattggaagggataccactacttgttaacaaagccctccatataatctcaggtaaatacatgtgttgtcaactattgactttttgaaggagaagcctgtatttttttcacttaaactatactagtattaggagaatgagactagttagaaaagtgaattggattcaggctgggtctcatggagctctcagatcatatcacatgagcacccagtttctccacctgtttccaaagaggacatacaatcatggccactatcacccaaattaatgtatatcacctctggcagcaatcatatctaacatttgtcctttcctcataaatgtgatgccaactatgagtcctgaccttataagggccaggccactgctttttccccattcgtttttaatactataaatataaaagttgtatttcaaacaattgagtgattttcaatctctgcttaaaaaacatgactccaaacgtggaagtcgtcatcattagattgctagccactagaatgtgaagataaatgaaatcaaatttacacacacacacaaacatgcagagtataagagtatatatatgtatatatatttgttggtttttaaactaaattagttttaacataaatacagagagttggaaataaaagatccagatcagccattgctgctattgtttctaatgatatttttttcataaacgttgtaggttgacattgtgaaaatgtaagtggcaacttttacagaattgcttcttataattatctcattaatattgggacaaattaggcatccagagaggtgtgggaggtggaggcaaagaaggaaaggagaaaggaataaagggagggagaaaatctagaataattctgttttgtgcatgtcaaaagctggatttaggccctgaactcaatgtttatcctgccttgcaaaagcttccatgtcttttcgtcagtttgttttgacccgaaactttgttttctcacaccagatgacaccagtaagttgcaggttgatgtgaagccttacatcccatcatttattgctgcaaagctgggtttttggatgtggtacttgtcttggacccagtgggtagtgagtgatggtgtggggtgccagtagcattactgaagtgaagtgtggatgcctgttgaccttagtgtgtaggaccaccaaggcacaagccttttttcaagtcagcatgatcctctgggaatgctaccgtcattctcacgtctggtagctttaacactgaatactttcatgctagcaatgcggtgggaaccattgtattgtaatctcatttttaaatgttttctaagaagtagaaaaccaatctgtatgcaaaccagtgacatctaagtaataagtcctttattcgggaatgttatcttcacatttttagctgaattgtgatccatatctcaaactaaataatggattttttaatggtatcttcaaaaggacacccaaataatccatcactcagatatatctctgagtagagaaaatgcctctttctttctcacctctcagtgatattattgcatcatgaagcactcagtatgctttaagtttatggctggttggctcaggacacataccgtggtgttaatgaggctggggtcatggaggcccgttagctttgctctgtttgctgaccacagactaccgggaaatcagtcaagagatgctagcacagacaagaacggcaccatggcaaaacctcagtagttctcagtttttcctccccatacaacaggcaggatgtgttagttgggcgtcatcatctcaaggaggaaatgagtagcagcttgggaggccccaacctttaactctgaacaaagcaggcctgacatttaggcattaactttgcattataatcccccatcataccattgatttgctgtgtaaccttcatcactaaagcagagataataggatagaatgaaatgggcttacctcccggagatgttgtgtgaattagcaaattaacgagtgtaaagtgttagcatttatgtaagtgctggtggttgtcattatttctagggacctagtctcattctaaatagagaatctaagtatattatgcttttgtcagaaagggattttcaccccacatcaattgcatttaagctgagcataaaacagaggtgataataacatagtagtgatcattgcaatgcagagctgtaaaccttttccctattaaagctagaactattttcagcaactttcaatgcttttaaactttgttttccaagttttgttatctctataataattattcttcctgtgatgggtggtgggaatgggacctggaataggtcctattcattattcattcccatgatgactatataatatattgaatttttttacatcatacaatcaagcaaatttggtagctagtgtgattgccacatattgcaatcattgtaaaaaataaaaactcttttctgctctgcctatgctggtgtcctctagaggtagccaacatacagattgaaaactcatggggaattgaagtgctttccaacaaaaggtgctgtatatagatcttttcaatttaacatctttaccaaagaattttgttgttgcctgctatttccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagtta

SEQ ID NO: 584 - DNA, 785176 bp, Homo sapiens
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcgcagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcagtgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatacaaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgctacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaaaatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccacccaatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcattgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatctgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgcccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctgcagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcgttaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaaataggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatggtctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacctgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagcgttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacggtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaacaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctccccgacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcattgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattctaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccgctataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttccctcattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctacatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgatcaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatataaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgccttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatacttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaattttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttatagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtgagccgagatcgcgccaccgcactccagcctgggccacaaagcaagactccatctcaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgcttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacaccttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacttactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaagtttaggggcaaataaaaaaggtatgaatataaaagattattataataactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttctaaaacttcagtaaactcttaaatatataaaagtgctatctttagaatttagggttttactcaattgatttttccttctacgtgtccacagagaatagtaacatacattatgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtatgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacataagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacggtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcagggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaattcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattgctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttatttatttttttgagatggagtctcgctctgttatttaagctggagtgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattacggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaacgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtaggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattataatatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcatactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatacgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgagtgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttttgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggcagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaaggtggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaatatatatatatatatatgtgtatatatatatatgtatatatatatgtgtgtatatatatatgtatatatatatgtatatatatatgtgtatatatatatatatgtatatatatatgtatatatatatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggcgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtctcgatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcggttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccatctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcaaggaagctaagaaccttgataaaaggttagaggaactgctaactagaataaccagtttagagatggacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaacccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcggaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcagtcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatagtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaagttattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggctttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacctggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaattgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcatgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttttaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgctgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccgcccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtattatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcgcttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatttggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaaaaaaaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttttttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataatagccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggcctttttttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatttagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggcgggcggatcacaaggtcaggagattgagaccatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaagtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggtttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttgggaggctgaggcaggagatggctcgaacctgggaggcagaggttgtagtgagctgagatcgtgccattgcactccagcctggggaacaagagtgaaactccgtctcaaaaaaacaaaacaaaacaaaaagcctctgctagcagatttttgatcaacattttcttttatcagtggcttgctcaattttatttatttattttttttttgagacggagtctcgctgtgtcatccaggctgaagtgcagtggcgtgatcttggcttactgcaacatctgcctcctgggttcaagcgactcctgcctcagcctcccgagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaagctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttatttttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtagctgggattacaggcgtgagccactgtgcccgccctatgccagttcttaaaaagtaagcttggccgggcgcggtggctcacgcctgtaatcccagcactttgggaggccgaggcgggcggatcacgaggtcaggagatcgagaccatcctggcgaacacggtgaaaccctgtctctactaaaaatacaaaaaattagccgggcgtggtggcgggcgcctgtagtcccagctactctggaggctgaggcgggagaatggcgtgaacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcaaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggaggaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcagtttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacactggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacacacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcgcggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggcatggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattcttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttaactctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccctgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgaatctgtctctgccctttgagtcgttcatcccataaattaaccacagctcttttaaaaaggccaaactgtcaaaaagtataagcccaagtaagatattggctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttgagacgaagtttcgctcttgttgcccagactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcattgcccttaccagcaatattacctagtggcgtgaggttaatttaaggaccaccatgaccactaagtgctatgttttcatacttttccacacctcatcagtgctcctttttttgtttgtgttgctcggtttccattcatttttgatgttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgcttcttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgaagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctatcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacgcctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgaatcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaattttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccatcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggagtgcagtggcgtgatctcggctcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagcatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttgttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttataattatcatttaactaaatagcactaagaactgtttatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtaaccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaacagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgata

SEQ ID NO: 585 - DNA, 498397 bp, Homo sapiens
ttcatttagtgcaagtagcaagtttatttcctttgatatagaattaacagagtaatgatgcccaaatgaggtaatattacatttgcttaggaaaactttccttgaaacacttatttagatctttgttaaagttattgattgtcagatcagagaaattgcaatcccaagtttattcataaaataaaaaaagttgttactttggaaatttcaaaatggcaattttatctcagagtcataattacaaggggaaaaatactctcttagccaagatcaagaatttcggcagcactgcaattctgtttacatccacgttacacaaaagcacatgcatttggcaaagagagtgcatacattcttattgcatcatttttcgttatgtgctcaattgccttatggtcccctagagggtctacttaacatgaattcaacaatgatgataatggggtcaccagtcatttccttacatatatagctctgatgtattcaattacatgtttttgatgttgtgctggtagtatatagatcccaattaaggagaaacttgggcctatataaacaatatatatggaatatacatggatatgtaaagacttgaggttgatgacctgacatccattaatgttaaaaatagtaaagtaaaaattccagtggcttagaaagatggtattttcttaaggacacactgctgaacacatggccacctacctgctctctaaagcaatatgtataatttaaccaccaaataaagaactgaggaataccaggagacaaaaaaaaaaaaaaaaggattaaagcccggtacaatcttgaataaaccaaaacctccagtacatagaaaaagcattgcaatcatatatttagctttatttttctaatatatatcataatttaaaactatataaagtcacttacataaaagcaattttttcaagtgttatagtttagagcatggctttatatttggcttaatcattttttttaaaaaccagtttaacttataaagctcgtaatcttgccagcagggcttcaacttcgggaactgattcatttttagaaaaagagccaagaagttccgtttccttttttctgttgctttctacattacacgcttccttcttctcagctgccttgatcctcccagtagacgtatgagtgtctagattataattaagctccttggcgactggagtccttgttgagttgcaattgatattgtagtgtgaacgtgacccttctgtcaactgcactttctgattttctacagtaaggaaaaaagaaacataaaacttatcaccatgataaccaaggactgtgcacgttatgaaacacatttaaaataattattctcaataaataagtagtcttcttagatagactaaacaaagaaacagtcaacagagtaagacaggtttaaaataatcacacaggggtttaagaataaactaaaatataacagccaaccgtttcattagcactaatgcccatttccttcttcctttatgcctgacatgcctgtcacgtggttattatcagggcctggtcccatatttctttcaggtctctgttcaaacaccacctaaaaagagaggccttccctagccacccatctaaaatagcatttgccctttgcactgctctatccttccccgtcatgttttccttcacagggcacatgatggctggacacacaatatatttgctcacttgtccattgtctgtcttactagaatgtgtgctccaagacagtagggacattattttaaatactgctgtaacttcagggcctaaaatggccctggtgcaaagtaggtcctcaataaatatttgttggataaataaataatttccacactctgtgacacaagattaaacattagcttgaataataatgagattaatttcctttttgaatgaaatcaagaaggaaagtttctaataagaatttaaaaagtcgattattttcctttaaagaaacaatgaacttggcaagcaaataattaaaacttcctagcaaaccagaatgttatatgtaattgtcaagtatatacacatctatacatacatgcatgtacatatatacatacacacatacattcttttattggtaagtgatggtaatgatgacttttaaaaaacagacaccctcaatattcatgtaaccttgaatggggcttgaaaatggcttcaacaaacctgacatgacatttaaagttttttggttattctctgagagatgttccattgtcccaatagtaatgactttggagcacaagcagtcactcatgacagtgtgttttatgtgagtgctgaaaattccaactgaaaacagcttgtacattaaaaggtggctgctgaagatatttactgcactgtcattttctgaccagaggcttccagtgatggatgaggattttacacactttcttggacaatctcaacaaattttagaagtatgatcaccttttagctgctggaagaaaataaatacactttgtctttcaccttctatatcaggtgggcaactgttactcaaaaatcaaaatctaatagagcagtgattttctcttaaaggagtgtatgctctgtagcttataatgtacatattgtgtttgccggaaagagcacggtagatgtggtattcctgcagttcctatgaccacatccttttcttttctagctcccacacctctgtcccaaagaatgcttgaaaactgcatttgcagctaaatgtagaatgttggccagcttactgctccttccccaaaatgttcctatctttgcttatttgatttcctgcaaaccactacatcatgatggtatctccaacaaaccagtttattctgctattggacaactctagttaaaagtctaatggcaaagaagagattaaattagccaaaatatgggtatagaatatgaaatgtgtgtgtgcgtgtgtgcgcgtgtccatgtatgcactccaagaaagtagggacattgttttaaatattgctatagctttagtgcctagaccgtccttggtgcaaagtaggtgctcaataaatatgtgttgggtaaagaaattatttccatactctgtgacacaagataaactttagtttgaatactaatgacattaatttctttcttgaacgaaaccaagaaggaaagtttctaatcagaatttttagtcagtggttttccttcagagaaataatgaacttggtaggcaaattattaaaactatatatatacacatatatatatatgtatgtatacacacacacacacacacacacaaaacacatacatacataccatcttatgaatagcctgtattttgttgcacttcaaacattaccaccctcagcatatagattgaggggtaaaagcaaaaggaggttaagtcatttgcttagacttagttactgagtaaatcggtggtagacgccaaatgctgtctctagagatactgaggctgtcttcaagaaatctgaaaacccttttgccaaaggaaagtgctaagtaattcaaagctaagtttcataataatggtgtcctgcacttatacttcaaaatgccttctaacacactgaattctcgcaacagctttgtaaagcagatagtacacctatgtaaactaccttaacacagtatatccaaggtcacacatatcctccatttctttcctggtctcacttagattcatgactatgaacttcaaaagcatgacctttaacccactacaattccctagtccattcactcttccattctcccagacaactgctccacaccttctccactctttgaaacttccaatatgtcctccctctcatttaactcactcatagaggtgatcagaagagagctcctgcacgtgcctcaccccttccccaacacctattatctgcctactgcacacacatacatccgcccctcctgttaggatgaatcaaccttccgagctcccctctgaggacagccctcaaggtgagtgacggatgtgacttttgcttggatgtgacttttgcttgtctattcaaggacatccctctggctgctttgccctctctctgctgcattgtaaaggtttctttctccaggtgctcattcccctcagcagagaggctctaataatcataaatttatgaggtggggggaatctctgtttgtctccacatcctgctccagctatctaaattcttggctccctttatagtaaaataccttgaaagaattgcccatacttactctcttaattcctcgctccctatttttctcttgaacccactccaatcatgcttttgaccctttactcttctgaaacagttcttgtcaaggtcgctaatgaacatgcatgctgccaaaaacaaggattgcatatctattttgaatgtcttagtactccttgatctataccagatccaaggatgaaatgcctagcatttcctgggtttttcttttagcgtttggtctttgaacttctttggagacaaaggtaaataataatggatgggccaaggcaggcaaaagcatttctatccttttgagaaaactcaaaatagctgtgggcttgctttagggacaaaatgataagagaaaaactaagatggtatttatctcctctgtggtttcaggtgaggaatctttcatgagaagtaacagacaagacagtgtaaaaaggaaagaggccattcctgagaccactgaagaaataaaaaagaaaagtgcacaagagttttttaaaagatgtttatagctttcttagaaattcctagataacaactcttcattcccagccctcacattagctctcagcaccccaacagcccccattctggtcctcaccttctttttggtttgtctccagacatgggagaccaaaactgtagaaatgagcaagtcagatcttaaactgcaaagcagataaatgaagctggacaggaggagttgcctatcccactataattagagatagtgcaggtagaggaagtgctcaagctggaagttcactttttttttttttttttttgagacagtcttgctctgtcgcccaggctggagtgcagtggcgggatctcggctcactgcaagctccacctcccgggttcacgccattgtcttccctcagcctcccgagtagctgggactacaggcgcccgccaccacgcccggctaatttttttgcatttttagtaaagacggggtttcactgtgttagccaggatggtctcgatctcctgacctcgtgatccgcccgccttggcctcccaaaagtgctgggatttcaggtgtgagctactgcacccggccggaagttcacttttttaaagcctggcaacaaagccaggctggggataagctatctacccgcctcagcgtcacaaagtgctgggattacaggtgtgagccactgtgcctgctgaccccagaagttcactcttatatagaaatcttattataatgtgtcaaggccaggtgtcttttgttatcaccattattttaaagtttgttattggtggctttgtgtgggctggagacctaaattccatgcaaaaacatgcacttagtttctaaatggttgactttcaaacaacagagtgatcccacaaccttgtaagttggagaaaactctatactctaccaggtgctcagaggcataaataaattgtaatttgaggcaggtaggccaattcttttcatatgaagttagacagttacaaatgcaagatgatacctaggacatatggactcaatgaaaggtaaggctggggtatcaataaaaagacaagcgtttctatttctcaactcaactcttcaccatacacacttttaaatggaaactaaaaatattaaggcaaagagggatgattaattcttcaaggtgaggagtttgttttattattttacaaattgaatcctaggccttttttttctgtttaagatattacaattgatctctatgtgcaatatatctaggactactgccaatattcagggccactgttgattgtagtactgataggcaaagaaccagctgctattcttagtaccaattcagtaagaaaatgcaatccacacatcttgtatttgtgtttctgtggaaataaacacgatgagaatacatgctattttcctttaagataggaatacttactcatttcaatttaattcttcataggattcttactataagaattgaatctagagacccaccacagctttttctttgaaactgaactaaaagttgaacgttgttggagagctgaatgcctcttaaatactgatacccactggacttaaaaatgagaataaaggccttaaactacatctagtgttgggtcccacatgatctttggcagagtatagatttggatgacaaagaaagcttaaaaaaactcattcatcctgtgctaatatttccactgtttcttgagaaacacaaaagacacaggaaactgggaaagttgctgacaaaagaattatgtatatatatgtgaatatatgcaacttggcatctaaatgaggaaatatttcagccaacagttgttatgcttcttgagctaagaaggcaaggctaactaaggccctggcggacggcccttggggaagacttctctgctgcaggaagtatcagttatggttcagaaagaggcattattcctttgaagttagtattgatcccccctcacattgtggttctaatgggcactggcttcttaggagtgccaactctcagatgaagtataaaattgagctcctgtcttttgtggtcaatggtgagttgtggcagccttgacaggaggaagaatgtagaactctggtgtcctaaattgactccatctattcagtgttcctgaaatttggtctctcctcgcaattctttaccttttgtttttaactattactttgacctactaagtagctgttttgtttcaccccagcaatggctttactttggtgaaagaaaaagaatcactcataaatataattttaaagcaccactgggtctacatgatagtaaagtgtgtgacaaatatatgtttttaatctatgcaataacggaagttagtggtggccgccagcagcccatatccctgtggttttccttattgctgatttactgatgctattaataattgtcttcctttggtttcatttcgctgtttatcttatgtattgaaaatatataaaaataattcaaagagcaaaaggtcattttgcatatagttaaaatcttttaggggtgccagaaactcttattaaaacaaattatgtaaaaacaaacaactaaacaaaacaatactccccctatctaaacacagtatgcaaagcagaatataatgatatctttgaatagaggaaacaactgatgaagaactttatttgcagaaactattatataaacttctattcattcttgttctgtatcactatcctttaaataaaattcaaagacagtactgccatttcacagtttcctatgctgagtttttctaattgagtgtagggctacaaggaagctcaagatgacgcaggctctgtgcacacaacaaccaggataggttcagcctctaaagagaacagtaacgtaaactcttctgtttgactgcttatcttcctgatttgtaatatgctacctgagttggatactcttttccatatctgctttcctctttttcatctctcccctcaattcttagcaattctaatttggctttcatccatacctctctattgaaattgctccttacaatattacccaaagcatcgaaattcctaaactcaattgcatttactcatgcctcttttttctctcacatttgcaacattttggaatgtgtgtaataaagaattcatctggtctttgtcccagtccctgggaggtggcctctaaagccttggaattttgtattcatgttgggcccctcagatgaatagtttgaaaccctaaactgatagtttttgctaatgaggtaactcatggtgggcccctagatagtttatagtaatgaatgactcaggatgggggttaaccaagccagaaagaccaatcatgtgattagagggttggggttttgagccaaatgattatcagcctgatttctgagtgagagatgggtacgggagcttgagctcaatcatgtggctgatgattcaactaattgtgcctaagtaacaaagccgcagtgcaaactcaagacactgatgttcaggtgagttttctggttggtaatcctctgtgcatccttacacatcaatgtgcagggaggctgatgcgtccctaaggacaataggggcttcaggtgtctctcctttggctgtttctgatttgtattcttttgctataataaagctgtaacaggaagtatagtactttcctgaattctgtcattctagcaaattattgaatttgagagggtagtaggaagcactgaatttgtagccaagtgatcaaaagtgagggtaacctagggacctcaaatttgcagctggtactgaagtgaaggcaatcttttagaggactgtgacctgtgaaatctggcttaacttcaactagctggtgttagaagtcaatgtagaatgttatttgtgactttgaacattattatggcataatatcgatatgatcatattacctttatatatggctattctatagcttgcaaacactttccccatatatccactcatgtgattcttataacagccctgtgagataggtaatatgggtatatttagtatatttaccttgtttgacataaaattgagaaagcagacataactttcaggcagagccagagacagaactaagtcctcagactcctggttaacatgctctatcatgatattgcccttgactgtgcttactcttctacttttcgatgattcattttaaaccttctttggtaatttgtgctaccttcccaacctctaccaaacaatcataacctcaacgtggccatttctcacagttacatctttggccctcttttctgccctttctaccttctctccatcacgatctcacagcttcaactatttcctctaggaagaagactcaaatctgcatttccagccctgacaacagagctccaataccgtatccaccatggcctccctaaacattcctacatatgccctactactacttcaaataacacattctcaaaccacactttcatgctcttcatactaacagactgaaaccaaccatggcatctgtttatcagtcatgctatctgttattgacagctgtctcagactactaagcacttgtggtcacctggaggtggcttggcagatattaaataaatatttctaaagtgtgtaatggcttgtcagctaatagataccaggtcagaagtaatttgatcagttgatctggtggttcataagggaaagggtagagaaataatacagggatatggtttgacagtatacttattaaacacatactacatacctgataaaacttttacatgctatcttttttcattttgtttttagagacagggtcttgctctgtcgcttgctcaggctggaatgcgatggtgccatgatggctcattgtagccttgaactcctgggctcaaggtatcctcttgtcttggccttcggagtagctaggtctacaggcacgtatcaccatgcctggctaacttaaacattttaaaaatcgagacggggtcttgctatgttgctcaggctcacctagaactcctagtcccaagtgattttcctgcctcagtttcccaaagtgctggagttacaggtgtgagccactgtgcctagcctttacatgctatttttaatttttttttttttttttgagacggagtctcgctctgtcgcccaggctggagtgcagtggcacgatctcggctcactgcaagcttcgcctcccgggttcatgccattctcctgcctcagcctcctgagtagctgggactataggcgcccgccaccacgcccggctaattttttgtatttttagtagagatgtggtttcaccgtgttagccaggatggtctcgatctcctgagcttgtgatccacccgccttggtctattttaaaatttttacaacaatcccaaagtgcaggtatcaacaagcccattttgtagataaggaagttgaggtttagagaagtccatgaactgccaaggccacacaggctttgctatttgcctctggcaaattcagtccaaatcgttggccctcatggttctgggggaacatgattaggccatggcaaatagacatgttgtgaaatggaaaaagcacttcccaaggatgaagaggctggggagaggtagattccgagtgctaataacttgcgagctgtattagaaactaactagctaactatttttaaatactttaggactagaacatatttctgaagccatttctaagtctcatcacatagtgtgcttttaagtatatttccttatttcttatacttcttcaacatttattagacatttcgaatgcacaggtatttcttctgaataacttatgctatttctgtttcatttcattttgattcacagaatcatgtaatgtagaatcaaatggaaagaccccttgttacttggtggaaccacctagccaatgctcgaattacatttagttagcatcctatcaagtagctatccagactcagtttgaagacctcgagtcatttcctcacaatctcatcaggcaatatattctacctttggtcagctctaataattacatgttttaccttagatttatccagtgtttgtttccctgaaatcttagtcactggctctgttgattttttccattagggctgtattaaatccaattcctcttccacccaccagcccttcaaatatttgaagacagatattatattctctcaatcttttcttctccaagccaaacagctatagtttcttcaactgttccttcagtgatcatgagttgaaattatggttaagtcagttcattagttaattcagtgagggtttagcccaccatgccaggtgctaagtttttgaaacatttaagatcctgtcatttctataatgaacatgcaaaacaatattcacttagtagttcaaaattctggggaaaagctaaagctaactagggtgtgcagtactgtaaaacaatacaattatatgttcatagactcctaaaaaatttccatgtagacttaatacttcaggttgatttttgatatgcatttaataagaatctgcttaaaataatgtttttattcattagagaattcagtcctgggatacatttgtgtttataactgttttataacaaaataattttatgtatgactatatacatagaaatgttcctttacttctccctggcctattactacatatatactacattagccatatctaaacatagcaatatgttcaagtagtaagaaatctaattcatatccatctaattgtgacctaacttgatagaacataagctctatgaaggcaggtatcttgttttattcactggtgtattcccaagccctagcacagtgcccacctcataacaagttcttgataatttatttcctgagtgactaaacccaagcatggcatgattttattaccttgcttcacttaatgttttaaactaaaccttaaaaaaaaagggaacactttggagtaatattacccagatacagctgatgacataacattttgctttattgtacatttttttgtgcttttgggtcccttgaggactcaacattgagactagaacggtactgtccaatagaaatttaatgagaatcacaaaaatgggctatacatgcaaggtaaaaatttctagaagccacattaaacattgaaaaaaaaaggtgaaattagttttaataatatattttatttaatccaatgtcaaatattatcactttgacatatatatagcaaaaatatattaatgatatctttggcatttttttgtactaagccttcaaaatcaaatgtgtatttcatacttacagcagatctctattcagaccagccacatttcaggagcttaagagccacacctggctattgtctactgtactggacagcacagatctagaacctggagtttttcacagtgctattacctatacattatgtatttagagttgaatatgtatatattataaacaagtgaaaatgaattgttccaatatttagcattttattgtgattttgtttcatataaagaggaaggagcagttatatatttctaggtaagttggatttaggtagcttctgtgaatggcaaaatagacaaaggctaaagattaaaaatatactcacaaaatctgaatgctaataatgcaagcctactgttgctactgtctatgttttggcatctgtttatccagccatctaggcatggggagactgggttaccgttcagagactcttctacttttgcttactagttctgtacatgttttagtaaatccatgaaaattaggaggatctaacttattaaatctaattctccttcctttcaaaatgagagtgacctttatgctattctcctattcgtattggatcaggacctatgtgggggttaggttcacagtgttgccattattagaagctgacggactggcctttttttattgttctattcatagcacagcagcattatcttgtactagattgatggtaccaagcttcattatgaaatcttaaactatttctaaaattttagtttcatgtatttctagaaaatgagtgaaaaaaagaaatctggcataagtcataggcattaccttaaagagagtactcaggctagtacactactgcctcctactgtcagtttgaggaaagtgagagagccctactcatccttatttctatttacaggtttacagacaagtggctttcttccttcaaaggacaattttgtgcagataacctaggaagaaatattgatgttctctgaatttccctgaattcttcccttgcttagactgctagatctgtgaaaaaaaatccagcaaacaccgtgagcatggatctttttccattccgaaaaagaaattggttttaaaggtaattcagaaaacatctgttcgtttaaattctatttcacattattttgttgttaaatttttcatttttctcttcttcccactttccctacaggacctcacatcacatctctaagaaaaagaaagagaaacaaaactctatattatttttaaatcttttagcagccttctcctaaataaaaatattaacaagtatgacatgagttaatatagcaggaaacataacaattcattaaatacagataaatgtttaaaagctgtaagttatctaaaatatgaagggagtacatgactacatgacaactcaggataaatagaaactacttatttctataactagcatatttggatcaatgatttgggtgctggttgtagagtcctctgcaatcaaactgcagtttcaattctgatggtttttgccgagtcaaagaatatgaacctttattttaaagatgagatttttgatcagcaaaataagtcaagcaaagaggacctttctcagaagctgctcccttttaatgaggaaaatagtaaaaggaataggtcaatgtcacttcagttatttttttgcaaataaaacaccaaagtttgattcctatgaaaccccaggctgcactgaggtctctgtaaaattggtttctgtaaacaactcatttttaacacagcattggcagagcttgtgcttcctgagactgtggacacaccatcagattgggccacacaatccccctctttccctttactgctgtagattcttgcctcaggcttctcttgtcagcagggactgtttcctcaaagacctgcttccagtctgtcttctcggggctttgggctttggagcacctcctgtctctatggtaacacaaaacacaaagactagaaatgtaccatacagagggcagaaaagaaagaaattagagtatagtactcctggtaagctaaagaaggttctgacagcaggaaaatggacaaggaggacaagatacagtaactgttagttgttccatttcacatacatcctcttaaaagagctataagtgttagcacagaagccttaaagtatgtggaactttataatccatgtggtatttgaaattaaaaaaatattggagacccatattggccataaatacttggcaattcattaagttactgagagaaataagaattctcggtggagacacaatgcacaaaaagaataaattacatcaagtattacggtatggtttatgttaaagacaaagaaaaatatgttactatcaaatggcagaatgttctcttttttatttttcaactctaaatacaaattttcctactttatttcaatctggggcatcatagtaaatgtagcatctgttagttcagtggttcaaaataatcagaaggtttatgtcctcaaactgttggtcagttccatttggtttcttggtcacaagcagcaccctgaactcagaagtgttgtctcaaaaacatggtggagtatatgaggaagagtaatgctgtcaatttaaaccccaaaatatttaagaaacacacacacctacacattaggaaagatatattattcatatagatatctaataaaaacatacattgtcatacatatgtatcctatcaggattttaaaaatatttcatgcaagcctatgacgtgttgttgaatatcagtgttgagagcttgttatgaactttagaatgcctattaaaaaaatgctgtagagattgcttggctgctgggcctcagggcagaatctgctgacacattgcaagcatttaaactcatagattaacgaagttggttctgacctctgttccttgaggtagttagtaccccaacaattagaccagcagaacttcagggatgctaatcatacacttacttgcagaaccctgttattaggatctaagaagacttctttccttagtcttttttttttttttaactcaatcaatgaaaatgcagctataagctatagccactagaggtcagacggctacacctgtcaccaatcattaaatttgatggggcattatagttccctgaataacttttggtgacttaaaaaatatagaacagagtacactcatttacaactattatggtaaaataataatatgtttattaattaattattctatttctaaaggtcttagattttgcaatggtactacttttctctattggctttcattttatttggaaggggaaggaaaacattgcaataatggaatctagaaacctttgcaattgatggaatctcatgatacgaaaagaccgctgtctggagtagaacacggaagcaatgtgttctgtagttttaccaaacacatttggtaatgcaactcttacgaaccttccgatctgaatcattttatttatctaatctaatctcttgccttttttctcctggtatatacaaatcttattgtacctagttatagctttacttattaaagattattataatgggaggtgttactccttgtctttccaatgaggtttattatgtggcatatcacacatactttgttaaaaaaacaacaaaatgccgggctcagtggctcatgcctgtaatcccaacatttttttgggaggcagagatggtaggattgcttgagaccaggactttaagatcagcctgggcaatatagtaagactccgtctctacaaaaaattaagagaaataattagccagggcatggtggcacacacctgtagtcctagctacttggaaggctgaggtgggaggatcactcaagcctgggaggttgaggctgcagtgagccatgactgcaccactgcactccagtctgggcaacagagtgagagcctctctcaaaaacaaaaagattaaaaaaaattttcaactataacacaatccacaaataaggaactcaaatttagttataacaaaattatgttcactttctcaccaacttattaataaaataactgttttaagtgttttttttttccatttcaggctatattttacaagactcattataaaaacaatactagtatgttagagcacttactaagtgccaggtttgcacaaagtgctttacaaaaatcatcatgtagcctaagaaagtatgatttttatactctctaattcacaatgaggaaggaggctttgtgggattaagaaacctgttctaattaagaggcaagttagggtggagctctgatgcaagctcaagtaatccaattcagctcctggctccaaactatagcactttaataacatttttaaactgtaaatgctgtaaaagaagcaggaagtatttctatatcagtacaatgaaccaaaaagaaactatgagacacttcatttttactgatattgcttctgacaaatatcctaaaaatatagttagctctctagttaaagagaaccaggaatgttaatttccaggttttctgcttatatggtacagagtactgtccatacttatctttgctgtatatctactgacaagagcagcaaaatttatggcccaggttcactagtacattggaaaatattagaagctagttattttgatgttattatacataaatcctcacattttaacaaatactacccaatttgtacgaagggtccagagtcataaaattatttttcagttgttttcttttttaacaaaaatgagctaaccacaaaaatcttgctctattatttatttaataatcatttattgacagggtcttgtctgtcgcccaggctggggtgcagtggcaccattatagctcactgtagcctcaaaatcctgggctcaagtgatcctcccccttcaccctcctgagtagctgggattacaggtgtgagcctccatgcctggcttcaatctattttaaaggttaaagttttagcatatagttttctctcactagcaagctatgctttaggacactattcttctattaggaaatagtgcagtttcttaaaatgcctttaaattttttagctgtacttatgcagaaaactctatataaaatactgcattaaactctatatataatactgcataaaactgtctgtataacaaggaataccctattccctagtctgaatcattgtctataataatctttcatccctcaaatctcaatcaaatatgacctcctgattttccaaaacatagcgatgccaacttgtattgtatttctctcatatgttttgtatcctagttagcctggtgttgtagttttttgtgcccctgcctcatactcaagtctagtgatgaccataaactattcaaagtagagtctatgtacttcccattctttgtgttaaaagcggtactttaatgcagatgtgtcatatttcatcataagattctacattcaagaggacaatgtttcataattctttggtgtactgcaaggcacaagataaagaatatgctttcattcatttagtcaaaagtatgaacagtgggccatgctgctttatgtttcagggatatggcagagaataaacagacacagtccctgccttcaggaagcctacaatctaaccacattcatatatctatatcgacagagagatttgcttattaccttccctatgtaacaagtagaaacagtaagaacagcttggattgtgttgagtagtcagtcaaacctctcattttttttcaaagccgtattgaatctggaatcttttatgacttttagcaaaattagggtccattttgtcttaaatactaaatacaaacatttaagtcctgtggttgtgttagattctaaaagaaaatacatagagctgggggtggggtgtcatctgtagcagcagatgatgaatgaagggaacataagcaatgtgaaggtaatagacactaattagaggaaatcttctaatccagactaatgaactaggatatttaggggactcattgaaagacaagaggcaggaaataaaaaggaagctatgtagaaatgcaggcatgaagtgataaaatctggaagagtttataaagggtgcattgggcagaatttgaagagcagcatacgaaaaaggaaatggatttataaccagaagtcctgagtttgagacacgtttgtcccagatgtcattacaaatggtggcttcctctaacgttctttcactgaggttaacctctttttactttccttgttgtcaatgctatactaaagaggaagaataaaatgaattcatcattccacctgggcctctcctaagagattagtgttccagttttccattctcttcacagtcagtctgaaagtaggtcttaatccaatggtgatgatggtaatgctaccacttatataatgtgcctgtgtgtctgccagccacgaggaggaacttgaataacatttctcctgttaattctgacatactcagtgaagttgttgttaatattcccattctgcagggggaggaaaaaaaaaaaaacaaggccaaggagccagctgttatctgtgagactctgacaacgttcttggtttgctgctgtggctttcttctgggccttcttaagagaactctgaatatctcaggcaaattaaaaacccttttatgggatgcaaggttgggaagcatctgttgtctccacagatttggagctttctgcctgagctttctgccacggagcaacctttatgtttatcaagctgtacgcttattgatttgtttgttctatggatttacagagaaccaaaacaatgttccccggctcatctggttagttgcaaacggtacatttgtgacagcttagatcagagggtgttgtattatggggttagtttatatataaaaggaaaaattgcaaaggtttcttcttggctttatcatttactttttatatcttggaacaatgctcttcatctgtttagacttcagcacctttctttgtttactggggatgattaaacaagctaagcctacaaaggatttttatgacaaaaacaacatatgcaaaagctctttgaaaagtacaaatcatactcatcacaaatcttgaaagtggctgggtttgggcctcttttctgatggttacagcagatagatcagtaacagacactaactaaagatagataactccgggttaaaacagagtcatagaagctttgggaataattgatcaacatatgtctttcaaggttgtacaaataaagaaagaactttcatttctaagactttcaatgtaatctatctcatcagcaaactggtttatgcttacacatagtatcgttaaattcctggttacaatgataaatcctatgatgtgtatttatgtgctaatttgctggggataaggtgggtggatatccaaattcagaataatatgtcctatgagaatggcagctgtaatacatatgaattacagctctttgtcattaaaataacctgacagctttctcttacagcatggtaacagcaatacacttaatatgaagtttgaggatttcagggcacctagagttatcaaggtaagaaataatttatggaaagattattggggagtgtaggggtgaagggtgggaaggagattttcttagagtcagagaaatatttcacattttcttaaatattggtgctttttaaactgacttccttctactcttaccttcaaatatcttgaaatataccttcaaatatatcgaaatatctgtgacatttgttttgagtagtaatgaatacattatgctcatgaataaatgagaatcagaaacagacaaagaagaacaattgacatctcttgtttaatttcactgaagacctcttgttcttatatccttgccttttccaagttcttgctggctatcaaatataggtctcaaagaagcaggtatgtggacacattagcgcacagagcatccactgaatcctcctttgaggtggttattgtttatctccatttcccaacaaaaacactgagcccagaagttaagtggattactttaatgacagagcaaggaaaagacagaaccagaatgaaaacctgtaagtctcagtttcaaggggtactctgtcatcgcctagatcatggattccttgttctgttgaaaggggggactctcttgtaatacaaagagatgataaatagagatggaaaagtggtatcactgttggttgtgtagaagaaaataatatactggagctgcaggagatctaagcagctacaggcttaaagattttgtagtaacagttggagtaagaaaaaataaagttctattgatcataaatcttgttttcatgtggaagatatgtgaggactgctacaattattttgaaattcctgtgtttctcttttatttggttttaatctgagataaactaaaatctatagtccaagttaacattgcagtagttaaaagttggcaatccccaaactaaatgtgccactgcatgtgactctgtgtatttagactcagcttcatcagtcacaaaatactttgtgatctataagatcctttttgattcaaaagctatttgattctataagcaaataaaattacattgaaaataatgttataaatatttgttagtggaatctgctataggagaaagaagtagataaaccccagaaaatgtggcactcagtcattcatctttttttctgaaacaaagggaaccggaagaattctaacttcagataatatgattacaggctagttctaagctgtaaatttgccagttactacaggccttatttagtaccttagagatgtcacttacaccttttatcttacactgtaagaataaaatcacaaaggatatctattcacatcaatgttctactcaaaagaggaaaaaaaattcggctcacaggtgactgtcatgcaagagtactcagaggttcgaaaagaacaaataagaaagcactttgggctcttcaggaaaaaaaaaaaagtactgctatttaataaactcaaggatcttttcccattgagataatgtataaaatgtgttcacggacaaaacatggtattcatttttaacatacttatgttttatacacatttactttgttgtagcaaatataatctctgagttatttcgggctaggggtatagaaagttttgcgggagaataggaagccttttgcctggcttgtgtcagaggtttatcaatttacacaaccagggtaagaacattctaaagcagaccctatcatcacacatcctcaggcaaaaccatgtgcaccaaagcattacagaaatagccttctgaagtagaatagagcactaggacaacaatgaaaaacattgcaaacaccagaagctttcatggtctttgacaagtcatggtatataaaacagtaacgacttcagagccatggaggtgctaggggttcatgtaaaagcaccaaccatttctctttgtctgctcttagttgagcttccctgtaaagactgagtctagaccaagaggcaatattaaaaacaaaaggttagagatcatcatgggacattaattatgcaaaagaaggcaaaatgaatttaatcagaagcagcagactcagtgcaggaagaattttctctttttgacagaagcagttaggaaaacatttatggtaataccacagcatctgctgattacagtcaaagctgcaggacaccagcgttaaatcactgagccatcctgacagttcctgggtactccagtcacatccaacagcaatttacaatgaaattcatccaagtctaaaaatcagccaacatgcctcaaccagagcaaaataacttagtttggacttttaaaaacaattataagagggaattatagctgataaaacttttgatggagtataagtatttgtctccaacaaatacagttttaaagaaaacacacccatttttagatctattaatatgctttgtgatcagtcatattttggaatttataggaagaaaggattttatgaggctaagaatacaggaagtagagttttaacccttttgataagacgtcaggacaaaatctgacatctcctcttagtgtcttgaaatgatatattgaaaaaactcagagaatgttaggataaattttaaacaattataacttggttgctaagcaaatatggataaaataaaaagttcagagagacaatgaaccacaatgtagtgtaacataaggatgattattcgatgaactgcccatagaagtacaggcaggacaaccacatgccattattacccactgggaattgctgagatggtaattaaaataatgaaatcctatagatattaacaactaaaactttaatacttaggtgtttcagagggctttcttgtggtcaaaaacatattggtgtctaaatttaaatctttgaatgacacaagaacccagagaacaaaagattgtattgaagccttcagagattagcattcacaaaagtaaatgtctcatattttatccaaaatcaataccaaagattttcttcccccagttgctttgggagttcagctaaatattattcataacatgagagattaaaagaagaaggaaacaaaaactttaaaatggctatttttgaaggaagccatagaaattgtggtcataagggatggctctattgttgtctttttctcagcttgataaattgtttcaaagtatgttggccaagctaatcactagcacaatattcacctgcaattttaaaatctgaatttctttattctttccccaaacatattaaaaatgtctctagacttctatttatagatatgacctattgatggtaaaagtgcacctgaataatcaaaaccactgacaaaaaaataataactgaaaaggtcaaaaagtggatcaattgaacatttcaacctcacaagtaagtccaaacataaatgaataatgaatccataaatgtttattgagcacctatatgcataagacacagagctaggaaccaccaagaagtttaaggtactgtcattggtctgaaagggaccagggacaaaagaggagcttatgttgactcatttttagtgtcactcaagtgtcaaatgaattgtgcacataataaatacaatagaattttggtggagtgaggtccacctagagatagtttaagtgaaatcatgcttcataagggcagggtctcatttcagttttgagtaacaataggattagatacatcagaaacaacttgcagggaactttacgtaaaggaaaaatctattaaaaatgctaccaagtacccatttagtggatggttaggattcaagacaggccacactcatgcagatgaatatatgaagacaatgaaaaaaactcacataacatgggttaactaatactaacattttagtatcaaattatgttggaaatttcacatagaagatgtttatgtaatagagtttcaccaaaaagcaatcaactacgtagactgggtttcatctttattatgtactagtcaatccccaggcacagaaagaaagcaatgattgagggagagataattgtgaatctcttgttatagaaagttaaagattgcaagaatttagcaccttctttcttctgctgcaagaaagtctcctgaaaggccacaagatttctgaggaagcttaaatacaggggagaaagtaaagaaggcctggactacctggggagagaggcattctaatcagtcagagagaagaatttgagcctcaagtattctgttaggagtacggcggcctcctgctgtccacaccctgtctccttcttcacccacacaagaggaaggaaggaatgagctgggaaaatgggaagtgcaggtggtatgataaaaccgatgaaggattgaaaatggattgcactaaaataaaaaacaaacagagtcgtcatcagcaaacagatggctcctaatagagaataaaatttgattagacagtttcccaagtatatatctggtgcaccagaatcaaggagaaatttttaggcaaatcatgaaggaaaactttcttcttcatggaagaaagcaaaattctgagtaagaaacgagaagactgctattctgcaggtttggatggagatattatttgacagaagttggtttccacgctgattttgatggcagacggtggggaacaaattggttttagggtggaaagatttggcagatgttgggggacaagttggttttagggcggacagatttggcagattaagaaaaaaaactgtattaagcagtgtgtgtgtgtgtgtgtgtatgtatgttatgcaagtgatgctttaagtaagctgatcacagaaaactgaagaaattcagaccatataattatgacccttccaggacatttttttatgctatgaaagttgctactctatccaaataatgttaaacacagacatccagattaaaagaactggaaggtcatctaatttgcacaatgtcactttacccaagaggaaaccaaggcccagagatattaactcatgtgttttcgacttgctcatggtgaagaaaggataacatgatggttacctagcttccaggtgatggggttgggcaactgaagttgaaacatcaactctgctcctttatttttcactccattaaaagtccaaaattcagtctaatttcatttgtctgtgagcactttatgccatgatacactgcatttttatagggctttatgtgtttcaatgcattcttatatacattactttaccttttcttcagcatgagcaggcaagaattaccaagttggctggacagatgcagaaattcaggcatagtaaagttaaacaatttataaagcaaattagtgaaagagcttggcctatgttcagccatcctgctcttgtcactagatcatattacatttgctggttggtataatttgccctagactgcattttctatacagaagaggaattgtatttacttaatgtaatgaaaacattgcacatttgtaacagtgttgttttctgctatttttcattacaactgcatagtgttacagctacattatgggttaaatagactcttgagggctagcctgggaacctaaccaccatttataacattctttctatgggaaattgctttgtgaattccaaaacaactgatttaaaaattaactttgggaatacactggtttcaaagtagaagattgttggtcagacatttcatgtgattggttgcttaattcatgcaattgaagcaaacaataatggattgcctactatgcatctaccagccattgtgctgaggccagggatgcaaggatgaacaagatcttaggccttgaggcactcatatctatcagagagaaacaaattattaaaacaaataaattataaataagtgctaaaatagagctatgggaaaaaatactgcagaagcaaagaggacagaggaactagacctccaggggatttactatgaaagtaacatttgtgttgggtcttgacatgtaagtaggagtctgtcaaataaagaagaatagtagggcattgcgggtagaaaaagaagcaaatacaaaatgctgggaggtaaaagggtctggtgtttagggagaatgatggcagcaacacacaggaaggcaggatggctgttaattatcagttgctttttagtcattaaaaatttaagtaatttcttatcttatctttttggattttccaaaggaaaggggatgactagattgagaaaattacacagacccttgccctgcatgagagagaagaatttctgcttactcatatcattagtcttgttttttatccccatgggtcatactgtcaaccttgagcaatgttttgctgaactatgagatcagatcaaagattataaaagcttacttactgatatctaggtgtttaggaaatatggtaaaagaccagtagttaaaataaaacctggcacatttgaaccatttccatatgcttgcttctgttaaattaatatgctttatatcagcaaaattataatctttttgaccacaagaaaaggtctcactgtgaacatatgatgattaaggaatattcagaataaaactcaacctgaaatttcagtctgtatatagatcaattttagttaaagcatgtagaacgaataaaataagcaaaagacaggaagcaaagctagagaaagggaaagaagtaaacaaggaggaaagaatgttttagctcaagtgcatttaaaatgtgtgagaaacttttttatattcaagtacataatccatttgcagagggctgactgagggtgtttgtgactatgtaaactgtatttctttcatgtataacataaacaaaaggatacagtccactgatcctttgtaaacattagttaaaaataatcctgactcttcagtgtgaagcttatgcaatgttcatgttaggactcaaatacttcattcagcctaagacaagtcaaaaaggattttaaaaagctaagtatagaatttagaatgtagaataccccatgtatagttcacagtattctctgttctatggttttgataaaaatactagaataaaacttatttttttaattacttggtacagattactcatagctttgagaaattctttttttttttttttttttttttttttagaaaagaatacaaacttttactcttgatagcttagctatttttctgagtacctgagaatatatctatgaaatctgatgaggcaaaaggaaggttgaggtttaacatttgagggctaataagaggtatgaatggtaaataaataattatgaattttgagccaaagaggtcatttaaatcatttctagttgtatcccttttttcagaccttttacatccccctacttccctgactgacacccccaacccccccatcccccgacaccaaataaggtctatattattggctgtgtctggaattcttggtaaggctcacaactataatccatcttctggacactaaagaatgctgaagcccagccttactccattctcctgtttgaaggtgacaatgttatagtcatagaaccttaggtttccttttaatgacaaggaaacaggcccagaatggtcaaaagatatgcctcaaatgacacagtgaaatagtcagggtacactcttttgccatgcagaaatcgacccaccaccaccacctccatcaaccataacctactctattaggcctctgaaaattcagcctggtgctcctcctttattacaccaaacagccgctccttgtttcatgttttccaggctgtgtattgctccctgggagttattttgggtctaatttacctgtcaaaagtgtgaaatactgattataataaaatctttcttctgactccaactctttctttaatcacagagcttacattctattggcaaaggcaggcattaaacaaataatcaaacaaatatgtaattataacttgtaagtacaatgaaggaaaagtaaagggtacaattatgaatgtaacaagggacctgatttaagttttagagggaaggcagtcacaggaaaattactatgagaaaattatatttcagaacagaacaagaaagagttagcaagacaggtttagtggaagaacggcattccaggtagagggaacagcgtgaaggcctccggtggaaggcgcttatgactggaaagtagtgaccaaagagaagagtgactggactgagacggaagaggtagcctgggcctgtgggtgagggtgttctgggacattgtatgaactgagattttattattttattattttattcaaagaactacaggaagccactaaaagatgttaggtaggagtatgggctggccagatgtccttttataagctctttgatatcatgaaactcagttctttgtctgattctgattgtcaaaactcaggcttaaaagtgtatgacattattccaaggaattaggaaaattatcagtgcaaatccctctctcctacttgtaaagacaatttaaagtagatgctcttggatggtctttatatagtatcggaattatttgcaatctcacatggaaactcattgcggaacaaaaacagcgtatttcccaatcttagaaaaaagtcacaaagtttatgcaaaattcatgaagcacgtgatgggatatctcaaaaacagtaaaaatgataatgtttttaataaaaagagaaagaaaattattgtaaaatgatatgataaatttgagtttcttacttgcagaataaacttgaagctttaatttatatagggaattatatttttaaatctgaattttaaatgatccttataatcctcatttagaaagcaaggccaaaagtgaattttcaaggaaatagtttctgaaataaattatgaaatgatgacatgtttagtatacaaccttctaaattcaacataaagaaaaatcttagtaatatcctaaaatgtgattcttcaaataagtgacttcattcttgtgatccctaattgttcttgtggtgctatatataaaccaaagtcaccaaatactccactttcaatttgtctaccattataagaaaggacagatatgaaagatattatatatttttgtctttgaaatattaagaaccaatagttagcctcagtgacatcaagaaaaataatcgaagaatggacttagtcaaggtaaaatgaaataggagactggtaaaaactcagataattgtgtatgactccaaccatcacaggatactcaagatttatttgctatagaatgaaaatctcgtctcaggtcagggtttattccgagaataagtgtatgaggttgatacactgattttggtctagtttactataaaggaagttattttactcttcatttgttgcacagttcttagttgaaaaatttaaagcttttcatccaaaggttagataatacattacaggaaagcataatttcatagtttctgaaattaaatttgtgtcttagttgggtacttcaacaacttaagaagaaaagtcactgaaaacattataaactagctaatttttatagcttctaaaacgcttgattgttaaaataaacaatgctcttgggatgcctacatttctgcttaataaagtaaattagcctttataaagtttcttagtgaacatatgactttagtaaatgcttcctttgttcctggttcttgggaaaatattattgaaaacacaaacaaagtaaaaaaaaagttacagttgtagaatgaaacaaagttgttcagtcattggaaacatctggtactgaaagtggatttcttaattattgagagggccctaaaatataaatattcacaggttcaaaagagtgctgccaaataggttatcaagcaaaaaatacgcaaccacctggagaacaaaatccatctgtctgactgaatctagttgaaaataattttttagacttgttagtaaaaccctcatgtaaaatttatttgattgaataatttactaagaatatttccataagcatcataaagtgctacagtcgataaaaatgaatatactaatcatctttctaactttgaaccactgccatagcttctagtgcatatattttgtaggttactagttaggcttcatttgtacctgtgatctcaacttgaacacaggattcccatcaataaagtgtggccatcccattaaaggcccactttacagggaaaagggagacagtctaatattcctggttgtagctgatatttacttgaaggcaagcagcataaatgtctttaaagatgtgcaccctggtgcttttgtcttccccaatgctggaactcaggtgatggcaaaagttagaatgaggaatgccaggaggaataatactaaatctatattctctctctcctggaacttttgtgcttgaaaagaacttgctgttacaatccagatggttcctcccttcaaacagaaataaaaggtagaatgcattaaatgagataatacaatgcacaaagcacagtagaaaagtcactagacaaatattagttctattaaatggccatggtctcctctcctaagtatcagaaaactgtaaaagcaacattcttaacaaagaagagagatctccagtcaggtaaatgatctgctaaaaagtgaaatgtcaatatacaaccaagctggattaatggttttaatactgaaatgtacactttaccctttctgaagactaaaacatgtacttaagaagttagtactaaaacttttaccagcataagagtattccaacaaaaaaattaagtactagaataaaatgacccttatctaaataagaatgacaatttaagctgagtcaaccaattaaaaagatatgcactggtaccctttcttctaatttaataatataaaagaggtctttaaaaaattatttgttctaccaccaaaacctcttaatgtggtcatctttaaaaataaaacagtagaactagaactaagttaacatacaccgttatattccaaacaaaggaaaacaacaacttactaaatcctcaaatgaaaggattgaaaggttgagaggtaaggatgcagctcttatctttcattaaaaaggatttccattttactgcacccaatcccattcactagcttctattcagatgacatggttccgttgatcttatgcttttaggcagagatccatcaagataatccactaaaaatcaaaatggcatgttactgaaattaacaatcactttttagaaatagctcaatggatttcatattatctggattgatttttgaacattaaacaacagatggattttaatagtacaatattagaatataaaatttagagcaatctaaaaacccatcagttgctatgattacagtataagaacatgtggagttatttcttggagacaatgccatgttctcttacatcacaaacctgttaccatgacagggaggacaaatgcctgctatatagtgctatgcatcccattacggtgggttcattcatatttatacagtctgtgatgttgatgcaatcactttagatctcactgttatttcaaacaaatccataactgagcaaaaggcaggatgttgacaggcattaatgtgggttttatgctgtttacaattgctttctaatctactaaatggctgtgaaaattgatgcacttttaaaagtatttttatatactagtacagacaaagagttggtttgcagtaatttctgtaatgctaaattgaattttctatggtgtttttcttatttgtatgtgttaagtaggttcccgattttatgtaaatcattaataaaccaaaaacatcttctcattttattaattgacatgtatttgcttctgcttgcagaaagaaagtaaaagtaaacttgtaattctatcctagttagttgcaaaataaacttttaattgtatttcaaatgaattagggaatcatattcccaagagatttggattatcctattctaaacctctgaatcatttaacttgagtaggaacttgactaacacatggtatgttgagggctttataacctaatgatagttgtaaaaattcagaaattccagcctgaaatattaggaataatacctcctcaaactactccacatgctgacaataggataggtaagacagcagaaaggtttttagaagaggggattcagggccgggcgcggtggctcactcctgtaatcccagcactttgggaggccgaggcgggcggatcacgagatcaggagatcgagaccatcctcgctaacacggtgaaaccccgtctctactaaaaatacaaaaaaattagccgggcgtggtggcaggcgcctgtagtgccagctgctcaggaggctgaggcaagggaatggcgtgaactcgggaggcggagcttgcagtgagccgagattgcgccactgcactccagcctgggcgacagagcgagacactgtctcaaaaaaaaaaaaaaaaaaaaaaaaaaaaaaaaaagaagaggggattcaactcatataccaatatctgtgattatttcatgtaatttatttaaatatcactacaaataaatacactctatgtggatggtcattaagtcatcgcagctaccaggaaactgcactgcctctttagctctgacagagttattattagagatatgtgacagatctaagaatcattcttccctgtgaggcccaccattggaacagcctggaatctgaggatgggaggttgggttttcacttccacacaagctatgagaaaaagattacctattgataaaaggaaaggataaatgttcaggatgtttaaaaacaactttaaatcattcaactaattatcagctacttgattattgtgccaatgtcttgtatttcccagaaaagggttagatacagtgaataattatgctttcattttaagatgttaatcatgtttgaaaataatagttgcttttacattcaattttgttcagaagtaaataacactcctggcattttttttacattatcttaaattatggtagtcaaagaaagttatgtattggtaaaaagaaaacaagaaagtccaataaaatgcatatgcccaaatgtgcataaactaaagaatgcttattgttcaaccactaaaatatggacagcatcctttcaatgatctgtcttctctctcctcatacttaccaatacatttcatgcttttgtcatttttccctcaacaagtcatgttgacatttatgaagtacaccatgaagaaaattaaataattgcttgcctgattacaatttcactctgagcttaatatgagattttaagtcttttccttgtggtaaactgatcttctcaaggacttaaaataacttaaaatgatgtctttttagtgaggtaacacaagcctattttactgcctcaaacaactaataaaagaaaaaaaataaatgaagtaacaacagaccttccatgacaacctgctacatttgaaaatcagagctaccaaacacaacagttgctgaagcaacctgaatataaaaatcctatttaacaatacttaactaagcaaaaatccctttcatctatctttttaaaatctctcttgcataaatattagaacaaatgtgcaaaaaagttgctaaattagtgcatgaaaaagtattaccaaaaggaatagcacaataagccatattcctgcttccttaaaaaataggaagtaagcaatattcttatttccttaaatcagcttgaagtaatctatttcctatgagtaacacaaatactggatggcaaggattaacagacctaaaagaattaggatggcatggtgcagtggtccccaactgcagcttacatgtgttcactgaagcaaaatgagaaaaataatgattcgggaagttaaatttatacaaatttaaaattatgtcctctctcctttttggtattaaaacatgctaagagtaaaatattagtgattgcaaaggataatctttaatacccaattattaattcaacagatactgaacttctaatatgggtcaagctctgttctaggaatagtagacaacaaagttgaaaaggtccctggctctcatggagcttatattctaggagtaaggcaggaggcagctcacaagagacacacaggtaaacacatatgttatagggtggtcagtacattggagaaaaaggcagtgtcaacatgctgagggttgtggttgctactttacaaagaatggttggagtaggcctctctcacaaagggataatggagcagagatctgtaggaatagatggagtgagtatacatatattttgaagatgttccagacagaagcagcaagtacaaagactgatgtgttctgggaatagcaagatggctgggacagctgaaggggagtgagccagggctggagtagcagaaatgaggtcagagagatgatggggacagatggtttggcccttggtctcttacttcactggagggttttgagaagagttatctcatccaatctgacttactaatttatttccctgtgtcccacccttttcagaaacactttggggcacagaatgatcttaaatccaggttttatcagaaagtgatttcagtaattcactccatcttaatttatagctggattttctccagggcttccttacaggactttgaacagtttggaatcagagcccactggggaaagtccatgcagtgacctcctatggactgttggagctaaattagaatgataggcttacatggattttctaatctttaaattaggtggaaagagctattatttttcttccaaacttgagtatgcagctcattcacttctcttaccctggtgacacccacccttgctgctccaaccgcacacacactctcccttggtcaaccttaaatgtgaacacttccctgagggagagagcttgaggtcatctgtctccatggcttaaacacaggcttcggcttcaaactttactcctctgtgctaaatacatttctgagttgcaaatctcggtttctatttgtatatggtgtatctccttcttgttcaaattcctcacgtctgaatggacattgcttttcttctgaaagaaaaaacttgcttctctttacattccccattttagttagcgttaccaccattttcccatttagcccattatttctaccatggggaaagatgaagggggaggaaagagcaattctaataatgatgtatctccccatagtataacacctaattgcccccttcccttttatccagcaattactcagctggaaacctttgtaatagtagtcaaatatttctctggtggggacttcctgtttggaggactctggaatagagggatgaatgtgtgcttgcagggtgaatacacagacacacactaattcctttattaggccacagtgatattttttctgacaagtatccccaagaatgtaacattggaggatgtggcagagagagagagctcaccaaatattctacgtactttctttcatttcccatatctttctgaaattaggtttaagccatgtgaaaatctctggttcatgggtatgacgtaacttgtggaatatttagggtgaggtagttaagagtcaaagtatctcctccatgcctctttccatggtgcaaagaccatgatcttccagaggataaagccagttgatggggggaagttgcctgacccacactggacttcatatgggaaagaaataaacctttattgtgttaagcccttgagattctagagttcatctgctataacggtaagtctttatgctgaataataaagattgcttggttatccttgttaaatcaaccataaatgttaaagagtagattattttagtacttctggcattcggtaatttatcaaaaatcatttccgttaatagttccttttattattttaagataattagttcagtagtttatttacttagtaaaagaagctactcagattaagtttcaaggatattcattttttattttagtattagaagatttggtatatcagtctttactaacaccatttctcttactgtatgtatatatacattgcatgtatgtatattttataatgttctctcccagcctctgcctccaagtctaaaaaattacacatttagaaattgatcttatccttctgttaattttagttgcgtgcattccattgtacctaccttgaggtatatcaaactcatagatactgaatgttcgcaatatgatataacaaagatcttggcctttgacatttttggtaattttgactgaaggtaatcattatacatcaattagatgctctctcgcaagccatctctgaaatccttagttccctccacagtctgaatccagtgcctctctagagacatacacagcactttggcatagaggtgggaacagtgatcacattgctgcaaaaatgcttgcttatctagctccttccaaattgtaacctaggtcagtttgaggtcagaggccaagtgtgtctttatctctctgtattcccagcacgtcatataggtcagagttcatagctgaagctcaataaatatttgtttgctcactgaataaatgaactgaagaaaattatttctgaaatgtttagctcattcaagaccatgacttcctattgtgggggttatgagctttctttcctagggaaaagtttcttaactatgattagattctcaaatgaatggggaaatctttcaaaaaggctaaaagccattgcttgaagatcacatacacacatacataaacatactaactcaatggccatacatacatcactgcattcttaccaccctgtattcatctgcccacctgcacagatctgcaaggtcttccctgggcagcgctccaatttattgattctttcctactagaaagtttagcgttccttaaaacctctgatatttgactgagtactgcctttctccagattatttgtaaaagtgttaagtaagcctagagctaatatcaatccctgaagaaacctattccttaaacttctcaaccttttcttcttactgtttgttttcctttcctaagatagttcctttactgtaagtaaacctctcatccaacctcaacgaataaagatttgttattatttattttaccatcttggccatagtaattgtatttttcttacctttaattaggaagatgatatacaacacccaggcatactcagcattcaaatctgcatttgtgagatgaagaaatgccctagctttctaactagatgccttctcattacctaacttataatgaagactgagccacttgtcataaaagaaattacgcttaacttacaaattgaatgtggttattttcagtctttaaaaaaagaaaacaaaatgtgagaaatctgaaaatgaagcgttatattggtcttgctagatattatattcacagtgtggaaaagctgtttatttaaaatattttatgctgacagagcttgattaggggaaaaggacttctgaaaatcagctttagaacacacgcacacaaaccttccctgacctttcacactgcacttacaaaggcattacatgactttaccattcagtctctcttaggaagtatttttattttcttattaacagcagtagaaaaaccaaagctaatatttaagccttgagatccccctccttaagatgaagtgagtacacaaaacatgaaaatatacagttatattctttatctctagataaacttccagaactatatcaaggctttatatggtctggcctcctgttgcttctctgacctaatctcctagttaatccctctacaatatacctaccttcttgctgcatacaagcacacttctgcattgagtccctatccttaaactccttcctgcactcatgtgcaaggctcattcacttcctcatctcctttatgtctgtcctcaaacactaccctgtggggaagcctgccttcatctctccatttgaaactgtatgcccctcatgctcgccactaccaatgtctggcactctctatcccttttcctaatctttaaaataaataaataaataaatatggctctcctttcttttctctttctttctgggattctccttatatacatgtaaaactgagctgtccaatatagtagccatagccacatgtgatgatggagcacttgaaatggctagctcaacttgagatgtggtgaagtgcaaaatgcacactgattttgaagacttcgcatgagtaaaagaaaacagagtatctgattaaaattttcatattaattacatgttgaaataatactttgaatatattgggtaaaataaattattaaaattaacttcatctgtttaagtaacatacgtgttccacattaggagtctatcggacaatgcagtgttaaacctttttgttgtattgcatgtccattatacttttttctatatacagcatctttttttgctctctgcttctgcctggatattttctgagagtcttcctgttcacctctcctgttttctgcttatctaaactgctattttatccagcactaaattcttaattttatagtttgtatttttcggttctagaatttccattagattcttttgatagattcttattattgggtgaagcactccctctttttatgtattttctcttcctctagtttctgaaatatattcatttcaaagtccctgtctagtaacttcagtatttggatcatctaaataactatttcttgtatgcgtgtttatgtgtgtgtgtccaaatgtcctatctcttagcatgcctagcagtgttttattgaaatctggatattctatgtatatattaaaaaaacaaaatataaaaagaaaacaaaaacctaggaggccccagatgatgttgtcttctacctgaggattcactttcttctggaaagaaaaggtaaatgtcttactaatctccatccagtcaggaactgagctaaccccaggctaagttgcagttttagcaagattgggtctattttgatttgctctatttcctagggcacaggcctccagggttttcgactgattgtctggcaggttatcatttcctcagcaaaaatagatcttcttcttagacttcgtctcttttgcaacccctcatcatccacagcttcagaattcagtaaatcttatgaaggggaaatggactctgtgctgaggcccttcaagtttccctttttgccagtctggccccacacaactgccgaaacgtggctggcttcttgtcccaaagcggtagccctctgcctggggccaaacccagattgtcaatctctcgccttggcagctgcaagtatcttcctacagacaggtagactttgctccaaaatttaagttcctctggtcctcactgtttccacagctcttggatgatctttgtttcctctggtattctagttgctcttggcaggaatgttgatctgccaccctcatacagaagcagaagcttgctgtggttatttttttcttagcactctttaccatctaacatgctatgtacagtcatgtgctgcagaatgacacttcagtcaatgaaggattgcatgtatgatggtgatcccgtaagacaaaactgcatttttactataccttttttatgtgtagatatgtttagatacacaaatacttaccattgtgttataatcggctacagtattcagcatagtaacatgttgtgcaggtttgcagcctaggagtaacaggttacaccaacagtctagatgtgtagtaggctatcccatctaggtttgtgttaggtatgctctattatgttcgcatgacaacgaaatcgcctgacaacatatttcatcgttaagtgccgtctgactatattttatttatttagtttatcatcatcttccttcagcagaatgtaacttccaggaggtctaagggtttgactatttttttcacagctgcaccctcaaaaatgtgaaaagaattagttccatagccattacaatggtaagataggagaaacctgaatgaaagtgattattaaataaaaatgaactgatttgtccttccagtctgacagccaagaaaacagaattttttttaccataatttactaggctcttcctgtgtgccaaacagtgtgtgagagatttgcattcaaaaatgattatagcctagtcctcactccaaagaaacagaccggcaaaaaaaaatagggattaaaaacaaaataaccacctactttcttgactcatgacaagagagccgccatgaatttttaaacacatggagaccctaattaaccacaaaccccttcgaaagtttctgtgggaagttatactcttattactcccacggtgccactcagattctactcagaacaatctgccaatttttctataattgccttcagggtctgtagcatctttgttttcaatggtggcaaaaatttttccccctgaaagtagatttgactttagaaacagtcagaagccctttggagtgaggcctgataaaaaaggaacctcataaaatcatttcagatcaatgagagaaaaccataaagtaaatgggacttcttgtgtgttttgtaaactggctctgaaggcaacttcaagaaacttgaaaatacagaagcatgaaaatattgttgaagtaagtacgttagtgttttctttcattattttagtcttatggctgaacatataattttcaaagtatacaatacacactgaaagttaagaatgaaagaatatagggatcaacaactagtatattgggaatatagggaaatatattactaattgttatggtaaatgagattattgagatttctcaaatcctgtatttcatggtttaaatgcacaactttcctgtgctgatattactaagcaggtttttaataatgaagagttctattttgtgtttcatgataattaactatgtatataatactttggttttcctcatttactgttgttatctagtaggactacgtagacgtttctcagtacccatgggggattgttctaggacctcccaaggataacaaaatccaaagatgctctagtccttgatataaaatggcacagtatttgcaaataacttattcacatcctcctgtatactttaaatcacctctagatttacttctaacacctaatacaatgtaaatgctatataaatagttgttacactgtattgtttaaggaataataacaagaaaaaaagtctgcacgtgtttagtacagaggcaatttttgagtatttcttatctgtggttggttgcggccacggatgctgaaccgctggatacagacggtcaactgcacatcttttacatcatataatttttgaatcaccctctaacatgaacttgagaacacatataataccaaacaatggtgaagagaaaagtaacttgttcccattttcagttgaggagttactaggtcaaatagggaagaagaaggaaacgagaaatattaagaatacaaataaaatacaaactaatataagctacgaaactgaaagctggctgctcgtaaaggtgattaagttactctaatatattgcttaatgtatactttgtaaatgttctgacattttaatttacaaaccctactatagaactccaaatgataagacactttaaagtgtccataacccatacataagctaccactttaagagactatttcttttatctagatcctgaacaaaataagttttgactgtgaatggtctgctgttaataagaggaaataaactagcctctgagaggtcaactttcttttgtctcctttttttctctcctgttagtcattctcagattactattaataattgtgattgtctatatttgcatttgtggacaatcaagatagccaaattgatttcttcaaatggaaagtactaacaaaaatatgttgctattttatagtaataacacatattttccatgggaatagtttgattgggtagaattgacacatgcatataaatgcaaggaattaactatgattatattattagcagttattgtggcaataatttcagaaaatggttatatccatctgtctgagaaaacagactttaacacaaaatgaagtcatattcattacacgaaaaaagtgattagaacctagtagtaaagccagctaaatgcgtttctactaagctccaagtttaagttttaatgcatttttaaatgtttctggtctcaaaacattgaacagctgacaatttccctcaagagaacaataccttgaggggaaaagcaattagaatatggattgaccagcaatcagtaatcattacttggtacattaaatgtagtacgctggcacctggttaagtaatttagaaactggttaagtatctggaaaacaggtttctcaagttaaatgtgaaagctcacagaaataaaatggactttctcacagttacaacgtatcaagaagaaaactgcagaataaggttttagaaagttaaaattgggtgaacatattaaagggaattggaatcaaagggattgaagtagaaaatctggtacttctgggagtttaaattccccaaagtttataacttagaagagctgatgatacatttcatatcaaggtttaatatttctatgaaggtggtttaaatatactgtacgattcgaaaaaagcttttattaaattcttaaactgcaagagaagaaatgaaaataaattactaagccagtgaaacaagaacttctacaaactcccttcactgctgacatctttccacctacatcactttgccagtagactctacctttcttcccatttctaccgatgaactgtccatgctccaataaggccaactcctcctcttgcaacctagacttcataatctctcattcaaggacaatgctccaacaatttactcatctttttctaacataccaatttctccccacttcatttcattattctctccagcaaacaaacatactatttctctcatctttaaaaaaaaaaaaacaaaaaacccttcccttgatcctaattcctcttcaaactactaattcatttctttccttcctttcattttattatttttttagagacagcatctggctctgtcacccaagctggtgtgcagcagcatcaccatagctcactgtagtcttgaactcaggggctcaagcgatcctcctgcctcagcctcccaagtagctgagacaacaggtgagagccaccatgccaggctaattaaaaaaaaaacgttttagagatggagtctcactatattgcccaggctagtcttgaacctccagcctcatcctctctttccttttatagcaaactcccttgaaagagttacctacaatcgcagtttctaatttctcttactctctcttgaactcattccaatcagatatttgtccctaccactgcactaaaattccccttcttcttgaagtcacagtagcctccacattaccaaatccaatggtcgttttacaactctgaccttacttgatttctcagcagacgggacacagttgtcactctctgctacctgaaattctttcttcctttggcttccaggacttcacccttgcttggttttccatctcagtgttttgtgtttccgcccttcctcctgagccccaaatgtccgtatgttccagggctgtccttgaatacattaactctcatatctacacttaatttcaaagcaatctactccagtcatattgtttaaataccatttacctactggcaatcccccaatttatattttcacagctctgacctgtctctggaatgcattttctgaatgctttaaataagacatattgcttttataataataataaatatattttaaaaacatgctatttattctggattttaaaaagaccttatagactaaaaatcctttaccaaaagacctttattcccatgtataattttttaaaaagttaccaggtatcaggactataaagatgaataaagaaacttaaaaatcacctgtcctctcaacacgtagagataactactttcagacacatataaactctttaaaatctgtaaaaaatgcagatctatgcccatttggaacaaaatcatacctgagaaaaagtttttaaatgaatacataatcttttgtattctttcagatgaataacttttatttctgggtgagcctgtaattttatagaatcattagtttaacatgatttacttttattaagttggtcttttttcaaaacaacagattggctacagctaagatagaaaagggctaaaaagtaaaagacactaccatcagagcgaacaggcaacctacaaaatgggagaaaattttcgcaacctactcatctgacaaagggctaatatccagaatctacaatgaactcaaacaaatttacaagaaaaaaacaaacaaccccatcaaaaaggtggcgaaggacatgaacagacacttctcaaaagaagacatttatgcagccaaaaaacacatgaaaaaatgctcaccatcactggccatcagagaaatgcaaatcaaaatcacaatgagataccatctcacaccagttagaatggcaatcattaaaaagtcagcaaacaacaggtgctggagaggatgtggagaaataggaacacttttacactgttagtgggactgtaaactagttcaaccgttgtggaaggcagtgtggcgattcctcagggatctagaactagaaataccatttgacccagccatcccattactgggtatatacccaaaggactataaatcatgctgctataaagacacatgcacgtgtatgtttactgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaacgaaacactgcatattctcactcataggtgggaattgaacaatgagaacacatggacacaggaaggggaacatcacactctggggactgttgtggggtgggggtaagggggagggatagcattgggagatatacctaatgctagatgacgagttagtgggtgcagcgcaccagcatggcacatgtatacatatgtaactaacctgcacattgtgcacatgtaccctaaaacttaaagtataataataataaataacaaaaaataaaaatttattttggaaaaaaaaaaaagaaaagtgctaaaaagtaataccatggtatatctgcaaagatcttaaaaaaaaaccccaacaacttcattttgattatttcaaatgtactctctacatttaaagttagttaaaaaatggcacaacaaattataaagctgaaaaagacatgccatttaaaatatgggagtagattagggatattttaataaaatggtgactcatctctcttattgttaaacaatcaagggagaaggaataataaagaacttgctcaattaacaatctggttaaaaatggctctggcaacagactgggttgccagttgtgtgagcctgggaaaatctgagtcttcatttatttgtaaacagaagataatgctgtgctggctctcatcttaacattgttgtgattaagtgagataatatacgtaaatatcctagcagagtatcaggccttttcaacaaatgttggctattactgcctttgtattaatttcttaaactgttttactacctcctttttcagaacaggtttattcacaaaagctattcaaataaacaagttaaaaaaaattcacagagctctgagttcagcttgaaagtttttaagcaacacaatttattatacagaacaaaacaatactttgagatgagtttcttctgtcaaaaagacaaaaacactcagaggatgtaactgaatgactataatgcaccctggccaagaagcgaggctttaccttgctctttaaagtacatgcaagtgagcactgttcttgtcattttaatatagactttccacccttaaattgactttatgaaatagttagataattgttgtgtacttttaagtcactttgccagtgttcttgaaccgtgaaagtaattaagtactgaactcataaaatacactccccaaggtccaagtttaagtgagcatagtgatttgtttcctaacaatggagcccaaccacatttaaaaactcctttgtactggacagtccttgaagcttggagtggctttcttatccacagcccttctgagcatcctgcagctaacagcaggtttttttttccctataatctactaccaccatccccacaactgtcatgatcaagaactatttatctccatttctaccacaccattctcactgactcaatgacttcttttgttattaccacaatgatgctattgctcttgctaccatcaccattaccacaccaccaccacctctcttactaccactatcagtaccatcgttgccaccaccaccatcaccaccactaccccctctcttaccaacaccactaatgatgagctagaagtaaactaagtcttttacttgaattacttcatttagtcctcagaacaattcaagatatgctatatccattatatcgatgaggaaatcaaggcccagagaacttaataatttttggcctatgttcctatattaggtgaatgggaaagccagaattcagatcaaagtttgaataactccaaggcacatgtttccatggcttagcatatcatttggcacagagttaacactaaaaaaaaattgttgcacgaataaataaaagttgtcatcctttgggtaacatggctcaatggacaaaggatggtatctgatccacaggcagtgtgaacttggcatgaggcaacctggcagaagaatgccttatgagacattctatactagacattatccaactcaccctataagctcctctcttgggacaataaaacacaaagagaaggttacaaatagaataggaccactgaaatcaaggaccagagagaagacaatatgttagaacaacaaagtcaagaaaagcatgtaaatattagccaaaaaggtaacagcattatatccagctggtaatgacaagagaaacagagaggcagaaagaggcagaagatacatcattaggatgacactgcactcttggggcaatggcaatatcctgaacaaccttctagttctccaagtggttggctaggtagctgcagacatggtctttcaaactttttgtctggcttctctttctcaaataaagcagtggtccttttctcaggaaacaagagactcatctgtctgttcaagtcagtaactcaagagccatatgttttattccccataaacaatcacataccatgttctgtattttctctctattcccactggttgaactttggcctaagctaccactatctcttatctggattacagcaattccctctgacctagtctccagccatcgactcgggccccctcaatccattctccatatagctggctcccacacatatcttatgcacctagctcagatttattcagctctcacttaaataccacttctttgggggaggctcaccttcagagtaggttgatcttcctgttattgacttgtcatcccccattttactttcttaaaactaccacacttacagttacttgttcactttaataagtcttcccttgtagatggcagtctccatgaaaacaatcctgtgtctgttttgtttaatactatgcaccagaggcaacctttttggcaccagggactggtttcatggaagacaatttttccacaggggtgagggggaaggatagtttcaggatgaaaccattccacttcatatcatcaggcattagttagattttcataaagaatacacaactatatatctcgcatgcgcagttcacaatagagttcgtgctcctatgagaatctaatgctgccgctgatctgacaggaggcggagctcagtgggtaatgcttgcttgcctgctgctcacctcctgatgtgccacccagttcctaacatgctgctaaccagtacctatctgtggcctgggggttgtggacccctgtacaccaagtacagtgctacagtgcctggcacataagaagtgaaacatatttgctcaacaaatacatcatctgtagtaatctgaaggtttttttttttttttatgagatggtgtttcactattttccccaggcccgtcttaagcaatcctcccacttcagcctctggagtagctgggactaaaagcatgtgctgccacatctggcacagtctgttttttgaaacctaaaaaactctcaataaatgatctcaaatgtgtctgtaaacatcttacaattaaaagaactaaaatttagtccacctccactgaggactgacattatgcaggcaccgtgcagagtgatctgggatggggaagtagtattcaaagggaagttctgaacaatttaagcagtggaatgactggataagatctgttttaggaagaaaaatttggcagcagtgtgggggactaaagtgagttaatatttgaggaaggggagctattaaattactataggtaagaagcttttttgatggcagagacagccacctacatggccacgtaacctagttctggctactaaagcttaaaaaagaaagtctgttaaaggacttccaagaaaaattccccttcataaaaacaggcactgaaaagaagagggcctgtcccaagatccatatgtctttggacatagctgtgtgtggatgtgatgccagttattctgtaagcatgagttgctgagccatggataacagccatggagagcaaaaaggaaaattaagagtctgaatcaggcctggcatcatggctcatggctcatgcctgtaattccagtgttttgggaggctgaggcaggagggtcccttgatgataggagttagagaccagcctgagtaacacagtgaggtcccatattccaaaaactgttttaaaaaatttagctagggccgggcgcggtggctcacgcctgtaatcccaggactttgggaggccgaggcgggcggatcacgaggtcaggagatcgagaccatcccggctaacacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaattagctaggcatggtggtacacacctgtagtcccagctacttgggaggtgaaggtggaaggattgtatgagctcaggagtttgaggctgcaatgggctatgaacacaccactgcctgctagcctgggcaacacagtgagaccatgtctaagttagaaataagttttaatgatcagaaaacaaatttcaggatgttaaacctcagtttataactttaccttttttttgtccccccttcctctaataagatgccacatcctcaactttaccttcacaatgcttcttccatccatcctgtctatatcagttaggatgttcccaaaagtggcagattgcttattacaaggtgtatttattgtctcacttaacaagaaatcctaagttttggctttttgatatggctaactgggccctgagggagctggctgggggtgtggagagtgtgcaacttcattttctagtgtgaatcatacagctcaattttataagaaaattgtttttgagaacaaaaataagtattctacctgtccaaaaaaaccaaaaaagtcaccagtccatattctccctctcccaagaacaataagggagcagggagaagaatgaaaaggggcagtactgacgtagtttttctcttttaaccagcttctcatgaattgagatgcttattataagctagcaagtaggatagaccgtattttccccatttatctatctagatgcagcatatggttgtactcctctctttcgttcatctaatatttgttaccatttatgatgtaaccatctattatcttgatggtaatgagagcacatcattatctctgccctccaagaataattcagaattcacctcaagaagacagcacaaattatctgctttgcaaagttcccagcacatggtagacgatcaaatatttgtttaatgcatctgttctgtagcagtacattttttagagggttctaaagaaaacttgtgaagataaaagcttcaggatatggcatctgattagaggaggggatgaggaaagagatgactagaaggcataattttaagctttgaaagttccttatagacacataacacgcaagcctctatttcttccataacatccttgacaagcaacaatccttttgcttcaatattagaacttgtaaggaagtcatgctgtcctaagagaggtcagtctatcactgtacagtcctgaccattataatgttctttagagtaaaaaaaaaaaatctgttcccctgttcagaggggagaggaaatttccatagtttgtcccaattatagcacttgaagaaagtggttgtggtttaatggaattaacagtgacctggtgacacaagaccaggtgtaactttgaacagggcacacaatcttgctgagattcatttttttctttctctaagataaggataatcttcacttgccacatttattgtgagattacgtaagtgaaagtacacagtgcctgcttgcagataaaacattttttttaaggtatgcaagaagataatgatactactgagcacttctaaggataatcctttacagaaagatgaaagttaaaaaaattttaaagtgggcataccacattaatgttaaatacatttaaagtcttaatgcacaaaaatgtcacttaacagacaactgcagctacatattacaagcagttggttatggacatgctcatcttttgatgactatttttaagttaaaatgcattaatattcatgattctgcctttcttacatttacaggaataatgctgcgcttgtatatccaagaaacttattttttttttgagaaagactcttgctttttccgcccaggccagagtgcactggggcaatctcggctcactgcaagctccgcctcccgggttcacgccattctcctgcctcagcctccccagtagctgggaatacaggcgcccgccaccacgcccggctaattttttgtatttttagtagagacggggtttcaccatgttagccaggatggtctcgatctcctgatcttgtgatctgcccgcctttgcctcccaaagtgctgggattacaggcatgagccaccgtgcccggccccaggaaacatttttaaaaaaagagataacaaagaagaagtatcagcaacaaaaatacaggtacctctcatggagacatgctctgtgccaggcaatacactaaacccttcatatgctgaatagctcctagtgcttggaaacccttttgaagtagacattattatcacctccattttacaaatatgaaactgaatgtaagacggcttaaataactcaaaaaaagatcacattataagcagctgaggctggatttgaaatctgttctttgatgttagactccctttatttgctcccttaatacatataatgggtgggtctgacacaattactgtgtttaaaatatatcactcattaaattctgctttaaatgagattatctatcaacaagggaatacctgactctggtagcatacattattacgtcagcactcttttgtgatgattctgtaactacaatgacagatggacctattaaaaaaaaaagtagtaagaataaaaaaatctcacttaattttttaaaaatttcatgtactgtgttaactatcataaaatgcaacagaaacaaagaacagtatagtgtcaagcgtgtacatactgtcttaaaaacagtgacaaaatatattcaaaagatctgcaatgcagcagtccaggagggttgacattagaaaaaaattattaaacccagtaagttaacgaaaccttagaactactccgagtttgggaaggaattaaaaaatcattaaaatgttaagaatttataaaacagcagttaaatttttaaataagaatagtatctatacataccgattaagctttaagtactttttccgtactttaagtattttgaagtatcttctcaggggcctacttgacagtgtgcagatggggtggccatcagccaactagtcaccttcagtgccatccagtgatccatggtggcaggaacttctggtctctgttgcttcctctactttcaagtcttgcattaatttgccacccaacagcccactcttcctggtccaaccaaggccagtgtgtacagtctgaccactcactcagaccatttgggataagtcttactttctagccacatgtctcctattcggttacaaatgattatacaatacaaatattgtatttaaagaacttttaaaagctccataaatgattaggttttgttttcagttatctatgcaaaatactggttggctttcccatataactggaaatccacctcaacattgttaggtggcaaccaagaaaattataggtataggaggataaatcttctgaaatgctacccttggagttccattctaccccactcaaaaaacaaacaaaaaaaccacaagccaaaccaaaccaaaaccaaaccaaacaaaaaaaaacaaagaaaaagaaaaaagagacagagagactattaaaatggacaatcttatttgtcattagttgtactgaacttatttctaatcacctatacagaaatcactaaacatacaacctgtaattttaacaatacaatgacagaaaaattaacaatgactgagctgctactgtatatattaggcactagccaggtccttttacattatttattccgtttcagacttatcacaacctctcatggttggaattgttattccagttttacaggtgaggaaaaacagtcttaaaggcacaaggtcagatccttggccacctccctgatgccacgctgctggtggtgaggaaaaagctcagacttaactttccttcctttaaaaagaatatcacagaacataaaccaccctaataaggtcctaaacatttagaggaattactatggaaagttcttgtcattacaaagctaaattcttcttgttctgaagtctccctgaatagctcagaaagaaaatcagatgtttagcatttgagaatccattcaaattttcagaaacagcaatagtgttttaatcaaggcaaatcattataaattataaacaccagaatgttaccggtctaaatgaaacacactccctgatcctactcatagctactaaatataaagaacttaatgaattaggttaatgtgcctgttaagatgatacaaggtagaaaggggacccccaaaagcaagtttccaaagtcaaattgttatgtcttctaataatagaccttataaagaaacattaatattaacacatgtactatacaacatatataattgagacattttcaatagtggaatgttgaaaaaggaaaaatgtaatatttcttttttttaaggaactgtcatttgttaaatccttttggtaggctgtattccaagaaggtaatattttgaactggttttcaatcatcacaaaggttggagaatatctttctgtatattttattaaggcttttgagagatgtactagatacttcaaattcatatattttagtgacaatgccacctcaaaatgtagccccccccacctaactgataacttaaagaaaatgtattcataatataacctgaaaataaacacaatataatgatgactgatagtccatttctttccctgagatttagctcatggtatgcctctgataaggaactgcatttttctaaatagcactcaattttctttagcaaaaaaacaaaacaaaacaaaacagtaggctgctctttttcttctgacataccatataaagccttccttccagaatattttttcctttgaaagtaagccataaaataaaatgtcgtgcttgaaaatcaatatattagtgaatggagacaaacgtatttgtgtgatttgagttcaattgtagcacatataatgaagagagccacatttttacttagtgaagatatctatcaaatacaatactaacattagttctgtttcctatttctaggtaaaattttagttaacaaataaaacactgtgatttaatgaagaatggattaatttgaaagctatgacacttaaaacttatggagagaggttggctctaagcaaaaaggtgaattaaatgaagcctgcctttggatgttgttttccttggtggtgacattccattaggccatgagcagctattggagaacacattccaggcaatgggttctctcacgctgctcatggcctatctactaaagatattccttcatgtgaagtaccctgcaacctgaatttgtgtctatacctctccttcttggtgttggagaaagctctttaaagagccatgctttctggctgttactgtcttctttttcctctctgaataaagaaatgacagatggcactctagcggtgaaattggactgagaggcagacttgggaattacaagctaaaggataaagagggtaagcattaagacagagggaacccaagtctgtgatgacattgtggaacctccatacaagcatcagactagctttgaatttctccatttaaatgaagtataaaagtcaatgataacttgagggttctctcctatgcacttgaacttaatcctaaacaattgaggaggagaaactggatagttgggaaggggaaagtgtatagctggaggacaatgggctatgttctgagaaatgcgtcactgtgattttgctgtcatgggaacattatagactatacttacataatcgatatagcctatatacacctaggctataccgtaacacgattgtaaatatttgtgtatctaagtgtatctaaacacagaaaaggtatagtaaaaatacaatataaagataaaaattgtacacctgtatagggcagctccattataatcttattgggccaccactgtatattgggtctgtcattgacctaaatatcattatgtggtacatgactatattttttcaaaatctgaattttgaaccatatatatttattacttagtccaaaactaaattctaaaaactgtaaaaacactatgctcaaaatattagaaattgttattaaatgaaaatttttttattttgtaaaaaaagttcttaaaaattgaacataaaatatttattttaataaacatgggcaatgtgatatgtcataatcatttcttctgtaaaaccgagaattttatcaggacaggaaacattgtgatcacctttgcaactagaacatccagtcagtattctgcatgtggctggtgcttgtaaatgatggtcgaacaaataaaatgctgtaaaatatatccccattccaaagagctgtcctctgtatgtgcctgacagttatctataaaactgaatatatgaggaagattttaggcaaacacagaagaaaaaaaattagaatttttgagaagaagcttagcagaacacagttattggtagttatgtaagctagtaagcaaacattataagtccatttatttatctgccccaataactcattttcctctgcaagtattcactgactatctggcatatgtaataatccccaagtgaaagtttaaaagtatatatgtagggtggggtggaggctgctgttaaaggagcactgtaggaatttagcctaatttccatgatttttatttttctaatatttgtattctattaaaacaatccaaaagaatacaactgactaaatgcacacttggctaaattttcatactgtaaaattccacaaataacttgctaaccattacacaaatcaagaattttgatttatagtttacatatataacacatattttttgggtagttctattataaaaatcacccatcttcccaaaatggattgttaacaattataaccagctgatatgaaaatttgattagaacagctcaaatggaattggcaagtaagggctttttaccgagcaaatgcataaaactttcagaagattgatagggatatgtaacttaatttgtcggtttcatttttcatgtcttggtaataaatgttattttgataaataaagatgattttattgcatttattgcactgggatttttatacaaccatggttcttcaagtaatataagaggaagaaccgtatttcagtactcaagctgttaactcatgttttttttaaagttatttgtcaatgtctcttcatctgcataagaactaggtgaattgacggtgtgagtttctctatgttctaaatcataaaaaatcccaaggaaaagaaatgagtgtaatagccctataaatatttgtggattgtcactaattctactttatttgcctttcaccagtgacttaggatacttttcattttatgttcatctgacaaaataatggcaacgacagtgggcaagaggttgtaccatacaacctcttggaacaaaatgtgggtggatctgagtttgtcccatttggcaccaatccagccatgacagtaggtaaaagagggaaggaattccagtcccactgggttgcttgtgtccagaagaacaagagcaaaactaatcaaggcagatagagggagttttgaaagcagcttctgggcaccaccaaaataatggtcagagtggtactggctgcttgtgctctttcagaagctgggctttacctgccagcaaaagcaagataaaagcttttgaataaagatataaccatatgaagcagcttttacactttatataaaactgctgtcaaaacattgtccataaaacatctaattatccctgtcaaaggttctgcattcaaagcccttaggaattcaaagccacaaaaaaagcttgccactcttcaagaatcggtatacgtcctcatagaaggaaataataatgatttaacctacagaggtccttaggaaacatttttcaaaaagagtctgagagccttatgacatggcctttattgatttttccctttggtagggttcaaaggaattaataaaatatgattattacttgtgaacaggtaatgtatcctggttatggtggactgacattcaacatccatttttaaccatctactagagtgtcttcctgtactgcagtggctagaagctaaaaaccacatcagagaccccatgcagtttggatgtgatttggtttggccaatcttcaaattgctcacggttaggatgttggaagtaaggtggaggccacgtttttgtggggtttcttgcaagtgtgactgtggaagcatttggttttctctcatagcaccagcaaccatccttgtatctagtcactagctgtgtagtactaaaaggcagaaagatagctctctgttatgctggtgtggattgtaacaggcactgcaaggttctgtgtctggcagtaacagtggtggcttcctgatcatggggacttcctgttagggagtggcagtgaggttctggagccagcagcttcccaattcagcaggcagtttctgtatcatagagcggggagcaaatgccatggtagcctgtgttagggcttcacatgtagctcatcaaagcttgatctaaattgtttcttcagtcctcctaatgaccccgaatccacttacaatgtcatgattaaatacttcactgcttaaactggattctagtctctgagccagaaccctgacctatacagcatgccagcacatacataccccttccaagaaatggatttcctatttggtagtgatgaggaagaggttctaaaactctataggaaaaataactcttcagaataatgttcagggactaatgggtgtgaactctttcccccactctgaatgcagatgtgttcttggtgacactgagatatattccaggaccaggagagctcaatgtttaaaatattcacttgagccaaggtgtccagattgttagtgtacttctagaatgtaaaccctaagacagtagtacagtaagaactaagcttcttagagtcagtgagaccctattttccagcaacagtgtgtcctggtagctgcaggtgcccattcatttctagaggcaatggattctgagacatgctacatctgctcctgctacgcatccatccaactttccataagatgttatacccctggctaattaaagtggaaacctaatttaactatatattgtgtgtgtgtgtgtatgtgtgtgcgtgtgtggtctttccccaccaatctatagctcacttgaagtattcaagtctcctggtaaaagtctgttttgtcgtacactgtctaaagattctttgttaagtgacactgatcgaaaatgatggtcttttttttttttcctttttgagatgaagtctcacactgtcacctgggctggtgtgcagtggcgcaatctcggctcgctgcaatctccgcctcctgggttcaagcaattctcctgcctctgcctcccaagtagctgggactacaggtgtgtgccaccgcacccagctaatttttttttgtatttttagtagagatggggtttcactatgttggccaggctggtctcgaactcctgacctcgtgatccgcccgcctcggcctcccaaagtgctgggattacaggcatgagccaccgcacccagccagaaaatgatagtctatctatctgttcacctcaatgtgttaaaagttaaaaaaaaaaaaaaaaaaaaagaatatgattggctgtcactatgggccctcagtttttgtgataaagggatagttctctattatacactgtgaggggctttaccagcaagtatgggtagggttgcaagacttggcaaaataaaataatataaaaaatgagtacatttagtgaagtatgaattttagataaacaatgaacaactttttagtatatgtataccctacacaacatttaggacatatttatattaagtattcattgtttacttgaaatttaaatttaactgacatttctatgttttatttggcaaccctagtagtagaaaaaactcgtgtgtgaactatcactgcagagtgatcttattccaaaccagcttaggagcctgagactgtctaaagaatttaagacacctgttttcagatagaaagaatgagctcagtatgggtaatccacggccttataaataatggggaataaatggtacacaaaactcttggttggccttactctcggtatttcttgggttttatttccttgagcctaaattcaagtatgaatttgcctagaagatgcagcccaagttttggcactctaaaagctctatttcctctttttcccctggctgttaggaagctcaaaaataaatcacagtattaacttttcacttcttcatccttaaaaagataagctaccttaaatcctttcaaaaggggatgggccataaattgccgattgcgtcaaatgagctggctttcctttatggtagtcacagatagtgaaagaaatcgttgtgaaaattacacataatagaaatcaccttcctaatttttacacctttggggaatagaaagtactttgtttactttaattcttctataagttcaaaatttggctatatgagttgaaaataagatagcatcttgcactattgttgctgtgaggaatatatgccccagaaaagaaaagctattctagagtttcaacttttatttatcaaggactgtattctataatacatagaagagagctgtatcaagcaatttactgtttttagttgttaaaagtgttctactgctaaaatctgagaagtgaaaatgtggctaaattttgaaatgtaatatatgtctgggaaatacaataatttgcagcatagctaagttttgctcaagtctggtgagagaacatgaaaaattttcagactagcaatttgctgactagaaaatgactatattttcaatcagcctaatatggcagttgtttttcataggcaaagaaaagctaaggaagacttagtctgtagatattcagcatagcttggcaaaatttagctgctagtttcttcttatccttgttatatgtttccatatgggacttcttattatcaagaagaaataatagaagtaaacagaagcaagaggaaaggtccagactggcatgaattaaccgcttgtcaactacggttttcctaatgaattgtcctgttgctctatatctcaatgattatagtacaacagctttcattagtcactgcaaataagacttactgccaccttatttacattctattgcaaataattagcatttcatattagattcgtccaaggcacttctgaacttgcagcaagactatttgacatcatccaatacttgattccatcctgaacaggcttgaaaacagattctgtgctttttagttacaacagtgtcaccaatgaattctaccatagcttaaattcctgccaatattgtagctagggatatcaaaatgctgcagtaattagaccttgcaagcctgacttccctagtggtagaactgtcacagaaggggaggaattgatattcaaagtttataataacccaaacctctacaattattgctagaacacgaatgccaccattttaaacagcagaaagcaacttaagaaaaaagccttattacaaaggtaaaagagagaggggaaaaatagcatcatatgctttgatgaccaatgtctttcctctgctaaaaatttataattacttattaaaattccaacctgattattaacttggtggggaaatatttctcttgaaaacatagctgccatatttaacagaatataaaaagcctattccattctatgaattaaaatttcactttacaagtatattattctagaactgtatagatttgcatgtattatttcatatagccaaatttatagaaagcattttatataaaaccacttatttctatttccatataattcatatgttcatatgtctgtgtgtccatgtgtgtttttgtgtgtctggacctacatatgtcatcttttatatgtaactcatgtattctctggaatgcacatacaataaaacaaggatcactgaatcaaataatgctgaatttgtgtgaatgtgttattcacagatagaaccagttaatctgagtataacactttgggaaagggcagccatcggtcccagacaatggctaggtctatttgcctgctcttatctgactttcctatcctatgttccatacaatgtacacctccttatatctacctcaggaccttattttcatgggataattgagcaccctggtccagttaaccaactcaagaatcccccaatcctttacatatttcttccatttgtacttagccatagatccagcctgagagtctcactcctcaatgcctggccaagaggggctcagatggctgatgtagtgacccttccctcataagggaagtgatctgtggggctattccgtctcaacattttagttttcaactgatggtttaactgtcctaactagacatttaagaaaaatgagtaattgagtgttaaaatgcaatataataaaacattagccttaggaacaaagatgtaaatacaaacacattaaaaataaaagtgtataagattgttgatgaagaggtcctggtgaatggagtagaaattagatgttagaaatcaagaataataataaaatatactcatctataaagccttttcatataaattatcttttctctttatagatattaaaaaacttcaaagaaatagaaatgggtctctttttacattaatgtttttttccttatcatgtctttcaatggggcagtgaattacttctatctgaagaaacctcttcaaaaacaaagcaaccctctgaggatttcttgcaaggttactgtgacctacagttaacaaagtaggtgtttactctcccctgacaacagctggtggtcaaatccaggctacagttccttagtggtacaggtggttgtttaggaaactggtaaatgataattaggtccaatatccctgaggtcacatagagcaaaaaaaaaacaattgtttgttattcagggaagaagacttagaacttctctgggctgatccacaatctgtcttcttcccaaatgtctgcctaaaatgaaactgggaatttggaaacatttccataggagtcattatcaacatccatccttctttctcaaaaaatatggataaatgtgtgggtttgaatcccacctctgccatttactagctatttaactttgagcaagttacttaacctctctgtgtctaaagttcctcgcctatgtgtgcggtatgtgtatacatatatataagccctgtgcattatgggattttggagatgaagtaagttggtacatataagggcaaaacactgcctatctagagtaggagctatataagcattggctcttatttctatggttaggaagacgtgatgtagagaaaataaataaaccatcatgaacttgtgaacttgaaaagggaatttcttgtctagtctgttattaaaaaggcctggctgcggcttcatacagagggtctaccaccatacacaatttgacatgcagccctaatacccgtattttggtctcagacactctcttccattaaagaaggtgagtgtggacagtaattgattctaagtcctgcagcagggtttaacaacaacaacaaaaagtcaaaatgggcctgggataccttgttgtcaacttttaaagataaatttaaaaatgcctagagtagtacatggaaacttaaagaaagtccttactagaccagtctgacagggcatcaaaaaaaaaaacagggcatcaaaaaaaacaaataaataaaaataaaggagaaagtcctacatgagttgaaatatattctcctagtttcttgtttgttgcttcatgttgtagtatctggtaaggctagacacccccactggttactctttttatttttaattgttactttatctagtttttgcttatttgcttttccattttaagaattagcttatctgttcctaagaaaacttctatagataatttttattataaatgacttaatgttgactgacatctttatgaattaatacataaagaattcctggaaataattaggaaaaagaactaataacccaataaaaatgggaaaagagatttaaggtataaagatataaagagatttaagttacataaaaaagaaaagatagaagagatagtggtaacattaattgacactgtagaaagaaattgtgtgtataagggacataggtaggagtaaaatttttgtaaattttccatttttaggtataataatgtattacctattaaaaataaagttataaaatgaatataatcatggttaattggaacaagttgacttatatataaacatcaatcatggcatgtagaaaaggaaaattaatatgtagactgtgaagtaatataaaaacaggtgactataataggatatatttaacttttaccaacacacaggaaagtattgatatttaatggaaaaaagtacttatgtagatgaatttttctctatgtatggaagtagaaaattgtatacatggggaactctaagtaagaaacatggttttacaaaggtaggatatattataagaagaagtagaaagctccaaagaagggctgtgggaggataaatcagtctcttgagaggacagctgactgtgcaccacgaagcctcctagctactgggagctgaaatctctgaataacttcactaatcacaatgagatgctcagaaggcacaagaatgtttctggtgaagtacactggaactgcctgtgaccaagacattcatgtggcaaagaagagaggcatcagaattcctggcaaggtgtgaaaatgtccaccaatgtaatataaaaagcttgactatagtcagtggactgggtcaaaaaaccacagagccagcactcatcttggcagaagcatgatcctaggtacgtatcagtcaggcaattacttatgacatttccccttggctggtctgaaatcatattgtctcttttttagtctagtaagattacagtagctgtgagcaggcacagagataagagttggaataatgaccagaaagaactctaatacagaagcaaacagtaattaaatagattagaaagataccattcaataatttgtactacagctgctcctggcagttgtgtgtggggtgaggaggaggtgggggtggagcatggggtagggaggagaacaaaaaacaatttaccataacgtggtagcatgagatctttgtggtactgaaatctgtatcttgattgtgatgttagttatttatacgtgtgataaattgcaaagacctatatacaaatacataacccacatacaaaaaaaaatgcatgtaaaacttgtaaagtctgaataagacctgtagaatgtaccaacatcaatttgccaatttcctggttatgtactagatattactattgggggaaaactgggtccaaggaatctttctctactatttttgtgacttccggtgaatacattaatatttttttttttttttttttgagatagggtcttgctctgttgaccaggctggagtgcagtggtgtgatcttggctcactgtagccttgacttcctgggctcaagtgatctttccacttcagcaaattgaaatttatacaaaatactctgaataaaaataaaattcagatggatcacagaattaagtataggtctaaaaaaatgagaggacaacagtttagttaggctcttgagttgaaagctattacagtatttggttttatctggtcagcatacttaaaaaaacagcgagccctaaattttaaatgtgacatttcacataaaaatgtagatttgtgatttttctatgagaaatagcaaaactagtcttagacatcacgtggctgaactaggcagcaactggcttcttcagataggacacattcttcaattcccctcaggcctctgcctggcacgccaatttctattatgtgcctggtttctggcaatattttttagcttttatttctactctaccagtagaataattttacacctttatgtttcataaatctggaagtgcttgaaaaattataaaggaaaagtgtagcatttgactacacaagggcaaacaaaacaaaaggaaatacaataaactgagaagagtccatagcttttatttttattataaaaggagagattgtagggtggaatgcatcacagaaaagtaagtctgctatttttttgcttgtacatttagctattccaaggaaataacttaaaaaacaacaacaggaaagtaaatatagacttagttaaaggtaaaatgaaattggtataaaaagtatagtagtagttgagaatgtgagttctggaacctgacttttgagatttgaggccattctgccttgcacttaaaacactctgcttttgttacattggcaagttaattcccttccttgaatcttccatttgccatctataaagcagagacagtattactgtctacttcaaaggatgttgagatgatcacatgaatgtgcatgtgaaatatttaacacagttcccagcacctatcagtgctcaataaaaatgagatggtattattgctgtcagcatataatcccaaatccttaccttacctgtctggtcccagcctaccctgctaatttctctaactgcttgccattccccattattcccttcttgtcaacatcactcttctactggttcttctaaaaagctcagatctttcctgcctccttgcattcactgttgcttacctgcaaacttctgggacctcccttcactgtagcttgaatgtgactaagaaaggcttctgctgcttatcatatcttctcatttgtttcattgacagcataataagctgctactttatttatttacttgctgttgcagaagaaggtggacatgtaaagtctacaagggcatgaacagctagagcaacccagcatctaaaacaggtgctccctggagcaacacaatgaacctctatggaatgaatttcttagcattaaactacaagacattggggaaaaaactgtcgattttatgtccaacagcaaataaaactttaagcttaaatgtttaattctgattaatgttctataaagttcacagaaaatccaattatataattatattaagaaagaatatttgggacccagagtcaagcaatagcacaacaaaaaagaatgccattctgataaatattaagcaatctaattagacagacaccatatctacttctgtatgacattttgacctgtaaattgtgccttctcaccgtaaaggcagctctgtaattacactgatcaccacagttaaaaagcttagaaacagaatgagtgagtaaatcaacgttgagacataattgccatattcaaagatcatacgagtttgcttgttatctatagtcctatatagttattaaaaaatgaaaaaggaaaatggtaagaagaaccaaaaagtaaagttgcttagcttttcacagctgaaaaatgtttgtacctaaagttagaaagatttcttgcttattttctgctggtttcacttgaatttgaagatttttaacatctagatgtctttactgatcatctttctcaatcctggtgtcttatgtcactgaaaacacttaaaagcctagtattatgagaactgattcactgtgctaaactatgctgaatctttgtggggtattagtttacggattagattagaacaacatcagcataatattcttaatatagccaaagcgagttaatctcttattctgaccctcattgttccataagatttggtttgtcatgttttcttatttgtacaaaatgctattttttaacatcttcctaaaaaagtcctcttgtgaaaaaaaaagtttattgttttccattccttcaaaatttagctcaaattatattcagtatctcaagtatttttttgagtctatctatattcttctcactagtgttacaaccaacccccttaataccaacttaaaacaaatagattgcaaataacaaatataatttacagactgaattataaataggacaaaacaattaaatatgcttaattgttttgtcctatttataattcagtctgtaaattccttgagggcctggagcttaatttttggtactttttttttttgagacagagtctcactcccatcacccaggctggagtgcagtggcaatcacagctcactgcagcctcaaattcctgggctaaggtgatcctcccacctcagcctctcatgtagctgggactacaggcgcactccaacccggcctgctagttttttgtatttttagtagatacagggtttcaccacattgcccaagccaatctcaaactgctagactcaagcaatctgcccacctaagcctcccaaagtgctgggattatgggattacgggtgtgagtcactgtgctggcctgatagatatatatatatctgatgaaaggtacctctcaagttttaggtttacttaatcagtgaaatcagaaaattagaacattatttttaaacttcagttctccatccaccaaaactggcattatgtgttccattttttagtggaaaaagtagaaaagaatagattagaaaagaaaatagaatacatcacctgtagtacaggtagaagtcgtgaaatttttgttttcaatttttggtagaggtgtgtgtgtgtatgtgtatgtagtgggtcttagtatattatgtttttctaaatgtgagttgcagttaaaaaagttcgaaagccactaggatagacaatctttaggttccttcattatctacattctttaatttctaaggcactcacttagaaatgatgttaacttttcttcttacatcatagctaagaactattactgaattataggcaattttatccaaaggagactattaaaaagtgtttaacagataagcacattaatgaatatgaaaatgttcactattgagtaaaacttgcaagaaatatatatctaaccatttcttttcctcaaaacaaataacaaagccagaacttaatttccgtaaaatctttcaatctaaaacacccataatctgagtataaagattgaaaagaaaatgaaaggtgctattgaaaaactagtgtgtaacttgtgtcttatcgtcttatcctgaagtttaaaataaaactaccaaagttcagatttctgaaaaaaagtccttataaaagaaaaatatataactttgaagaattctctacaagtaaaatttgaagaataatatctaagataggaaggtttagttgtattaaagtcttctgtaccaccagtgccatcgccctttaggtttctgatatatatttgtgtaggaaacaaaaatcccaagcaaatagtcacccccaatctcttttcattatcaacctcgacagttcaagcactgttcagtgaggacagacatgtggtatggaatacgacacttccctcttcagcacccatcaccacagtcatcactaaatgagcaccatgttctttccaattcagcattttccaacccagtgctcaaagaagtgaataccaaccaatgagttgttgggaggagacagtttcttatttggcccaggccagaatctatggcatgattagtatggaaaccagcttgtcatcacatatacacaccctacgcattcccagtatgcatgcccaattggctaatacatacatgccttcagaaatctggttgatttaagattataattaggcatgatatcatcaggaattctaacctttcattgtgtttagttcctaaagttacctgacttgataaaactatttatttatattcttcaaactgaggagttaggtcatatataaaaggtagatatttggttcttattatcttccttttttggctccccttttaaactcatgttcccatcaaacagcttagtaggaatgatacataatacgtgacattctgcattaaaacatataagtatcatttatggataacagagtactgagggtgaaaaaagaagatatgaaaagtgggtctaatccaacaaaaaccacctaaagcccaattatgaaaaataaaagcttattttttccttttttctcatcaatatcatctcatatcaaaagttaaagtttatgaattattgaattgatgagtagatttacccctttaaatcatctaactttgcctctgaggagtcatgtcacttcctcttcatgtcaatgtcatgcatggctgagttgctacaatccgctttggccactaaagctcaagtcattcggagccatcaaatcaattataacagccgctgctgtcttacaccgacaaccagtgattgataacaaaacctgtctgctttcagttctcatctgatagcaacgacccagtccctgccttctcttactggcatttgtcataaaccaatagcaattccaccatgcagaaaggtgcaggcggctctcttcagtccatctggtctcattttattttcaaattttaaaaaatataactattaagcaagattaatgccaaaagtttatttcttgaagtatctaacattacctgtaagtaatcccataatacagaatctctaaacaaaaatttaacaccacagaagactcctattatttaactcaatttctaaagtgagtcactaaaactttgaaagagaaaattttacattctgaaatctgtgacttttatatttagtaagaaaaatcatattttctttcaggttattccagatatgatgtcatgttttaaatagaatgtttacaaaatattataataagacttcttgaaaaacagaatttttttttactattaagcaatgtcattacaaaaatgaaataaaaacaatgcaatattataagcaaatattagtagcactgaatattaattgcatatagaagactggttttacagatatgaaaatataaaattattggcaaagctattagttgcagactaaaaccagtacactttagatattttgtgacgttaaataaacacctggtcatttgaaggaaaagaaaacaacactgatctaatttgcagaatttgaagaacattttgaaagtccgtaacaccttactatgcaatcttcaatggcaaaaaatatttaataaaaaatctggatacatttgacatcgtgttaggtggtgtgctaaaataaatgggaaagaatgatcttgcaggtatctttcacagtacaaacaaaacaaaggcaattcaaaagaccataaggcatttatatgagagggagaagagaagggaatgaaagtaacatatatcaggtgtctattttctataagatggtaactgatgctttacagacatgatttcattggctgctcaaacccatgaggtagattttttttttccccaacttataaaaataaaggcacgggatcctgtcaaagagactgaatttgaattcagttctgcctaatttcttttttttgttgttattgttgtttgttttaacttctattttaagttcaggggtacatgtgcaggatgtgcaggtttgttacataggtaagtatgtgtgatggggatttgttgcacagattatttcatcactcaggcattaaccctagtctccattagttatttttactgatcctctctcctaccaccctgaaccctctgacaggccccagtgtgtgttgttcccctctatgtgtccatgtgttatcatcatttagctcctacttataagtaagaacatgcagcattgggttttctgttactatgttagtttgctaaggataatggcatcaagctccattcatgtccctgcaaaggacatgcttgcattcttttttatggctatatagtatttcatggtgtacatgtaccacattttgtttatccaatctatcattgatggccacttgggttaattccatgtctttgttattgtgaaagagtgctgcaatgaacatacgtgtgtatgtctttacaacagactgatttatattcctttggatatatacccagtaatgggattgctggattgaatggtatttctgtttttaggtctttgaggaatcaccacactgtcttctatatagctgagctaatttacacttccaccagctgtgtaagtgttcctttttctccacaacctcaccaggatctgttatttttttggctttttaataatagctattctgactggcgtgaggtagtacctcactgtcgttttgagacttacatgttcgttggctgcatgtatgtcttcttttgagaagtgtcattaaaatggccatattacccaaagcaaaaaatagattcaatgctattcccattactaccattgacattcttcacagaactagaaacaaaaatttaaaattcatgtggaactcaaaaagagcccaaatagtcaaggcaatcctaagcaaaaaagaacaaagcttggaagcatcacgctagccaacttcaaactatacaacagggccacagtaaccaaaactgcatagtactggtacaaaacagagacacggactgaagcaacaggatagagaaataagactgcacacctacaactatctgatctttgataaacctgacaaaaacaagcaacgggaaaagaattccctattcaataaatggtgatgggataagtagctagccatatgcagaaaattgaaactggaccccttccttaaactatatataaaaattaacacgagatggactaaggagttaaatgtaaaaacgaaaaccataaaaaccctggaagacaacctaggcaataccattcaggacataagcacaggcaaagatttcatgacgaaggtgccaaaagcaactgcaacaaaaacaattgacaaatggaatctaattaaactaaagagcttctgcacagccaaagaaactatcaacagagtaaacagacaacctacaaaatgggagaaaacatttgcaaactatgcatttgaaaaaggtctaatatccagcatctataaggaaattaaatttacaaaagaaaaaataaacaacgccattaaaaagtgggcaaaggatatgaacagttctgcctaattttaatgcctatattctttgcatactcattatcatttattcaccatttattgagaatctactatgtattctatgttaagctaagcatcagacatagaaatatgaacaaaacttaggcattgggactattgttaaacaaaatcagcataaaaccagggaagttttatgtcagcctcagagtataaaaaagatagtatcatagtgagtaaggcagcaataattttactagctccaaaccccaacatacgtggacttataaagcttgatgtaaatcttgatttaggtaaagagctgtaaggcctggagtaacttactctcttaacctcaccttttgctcatctgtaaaagtggatttacctcaaaaaggttattctgaattccaaatgaattaacctatacaacaaaacactggccattatagtagttgctcattctacgcaaactcttatcttcaaatacattctaagtttagttgccatcctcagaaatatacaaggcctatcttcttcatttaaaatataaaattaggccgggcacagtggctcatggctataatcccagcactttgggaggccgaggtgggtgcatcagttgaagtcaggagttcgagaccagcctggccaagatgatgaaaatctgtctttactaaaaatacaaaaattagcctggcatggtggtgggcacctgtaatcctagctacttgagaggctgaggcaggagaattgcgtgaacctggtgaagggaggctgcagtgagctgagatcacgccactgcactccagcctgggcgacagagagagaatccatctcaaaaaataaaaaacaaaataaattaaaataaacaattacctgatatctagaattctttgaccagaactggtgcccatgacaacaacggcctggggtcatcttagtagagatcctgctcaagaaggtggcctgccaaagcaaggggaccacagaggcaagagggtgggggtgaatggggaatgagtgggatcaggagtggctggctgtaggagtagaaaaagctcagcagaggagcctccagggaaacagcgagctctgtggactggccagacccaaggcatgccaacttgctaaagcagtacctaaattgcttaagaactgtcttactcctttagctttcttctccctccttgtactggagaagggaggggctgttatgacaggcaggcccccaccaagacggatttaccctactgtcaaatactaagactactaaaaagaggatatgcacaagggaatatattcctcaactgatgaaaacctataatcccactaatccatgaaggtatctttaagtggcaccactttaaaaatctactccttcacataacagcttgcaacacccataagggaattctttagatcaagtcacttctgcatctgttccagtaacagttacagactgacttgaaatgtatcttttcaaattttgaaaagtcagtttgaccactgtacatatttacctatatgcctccttgtatactgagatattttccctaacacatcatctgtccataaaaacttgactatgtttacaaccaatggctttctcacttttggaagctttgcttcctttttttccccctttttgaatttttctttttacagaatagaagcaatacaattatatgtattaagaacatttcagggctgacatttaaacgctctccttactggcctcccatctctcctgatcatgtttcttaagaactatccctcgtgcttaggtccaaagtatcaaaattaacaactgttagtagagggattagtaaagggatttgaaggtttgaatttgcgttttgttaagaatgtgatcctttagaataatgtgctgtataaaataaactgactacgtttcatctactgaattgcagttcgaatcttgaatgtatttggcatcctaatactgaactgttggaggctgcatggtataatacaaaaaccacatcaaatacaagagtcagaaattttttactccatatgtaacactgtgagctgatgccttaactcctctaagtattcatttgttaattgggaatactaataccaacatgtgccctcacaatacccttttgagtattaatgattacagcaccggtgctagtagcatcagaagtacaatggtcactgtggtattcaggtctacttcagtattactctggaacaggcattttgtgaactgcttttacatatagaacttatttagtaaccacagacatctactaaatatgtttattttattgattttaaatagagaaaactgagacatagagagattaaacataaagtaaatatcaaaactgagatttgaatccaaatctgcttatcccaatgtacatcctctttatcacagcgctacagagactcctgcaaagcactactcaaacataatggaggaccctgaaaaatacacaagagtataaagtcaaccctctgaatccacaaattcaactaactgtgattcaaatatattcagaaaaaaaagttctagaaagttccaacaaacaaaacttggatttgctgtgcaccgacaacttgaatccacatgaatgaagtgatgtgtaggcactgtatttggtatgatcaataatctagaggatgtgcctaggttacatgcagacactatgccatgtttgtaggagatttgaaccaatctcctacaaatactaaaggatgactctacttacatgccaataatgaaacttcagcagatatacaccattcacatttttgataatgtgtatacactcatttatctacttattcgaggttatggtacagaattgtttcagactattctttgtttccttaaaaatataccccatgtaagaaccattacggaatattttaagcaccgcatttaagaaatacctatttttgagtcagaaagatctgagttccaattcacctctaccatattatacctatgagactgtacactaatgatttcatctctttctctttaccttggagatgagaataatctgacttgtttcctagaactgttgtaagagttaaataagataatagatagtacctgtcacatacagagtgctcagtaagtgatgtctgagaatattaattacagtgatagcactggtgacatttaattagcctgtttgctgggatttcccagatgctaagtctaacaccaagcacgaagttcttctacagtttgtaaaattagcaaacaatggaaatttaagcaataaataaaaaatgccacagaaggaagtaaaagcaaacttaattttaacttaggtatcctgagaaaaatttcatcaagttgtatataaagggtcaagaaacgtaccgcaagctggaattaggtaacttatctacctttatttaacaagttagaatcacttgatctatattagagaaaaaatatatttacttcccccttcatatttttcacactattataaaggaatagaggtcaggaaatgaggaaataaataagaagagatgaacaaagaaggtgtagccccaaagcatgaaggccattttctcaaagattgttggtgaacagctcaaggaatctatgcccaaggctgggaagagaaaagaaacaataaggatgatgagcagataggggtaagggtaagtggtgacctggaattgtaggaaaccaaggtgactagttatttgttctgcctcactctagctgttaacggatcatttttacagcttgacccactgttactcctgacaagacaaacatgatcaacttaaagaagactttaaaatgaagcaggtgctttctgaaagaaaatgaatgagtataagggctggggtagttaggaaagaagaaatacaaagggaagcttttttcttgagttttctttctttataggcatactttgaaaagtgtatctatagagaacaaacacataaacaaaaaatctgagtgaatatctatagaggggaaagaaaaaaattatactcttgcagcatttatgctattgtactacataggtgagtttctcatattccacctaatgaaagtattacagatttacgtgtatctcagagagacaaaaacagaagacaaaactgtaagtattgctagcagtaagaaagtggggggccaggcgcagtggctcatgcctgtgatcctagcactttgggaggctgagaagggggaatcacttgagcccaggagttcatgaccagctggcaacatagtgagatcctgtttcaaaaaataaaaattggtcaggcaggagctgaggtggaaggattgcttgagcccaggaggttgaggctgcagtaagccgtgattgcaccactgccttccagcctgggcaacaaagcaaaaaaaaaaaagaaagaaagaaaagagaaaaaagagggttacaaaatacaacttttaatgagatattccactctataattctaaacaactgtatcatcttaaataaattcaaaatgacatagggggtaaaatatttcctacctattgcatggttcatgactgagacccctataacgaaagacatattaacaacagaaaagcatattgtattagtcttttctcatgctgctaataaagacatacccaagactgggtaattcataaaggaaagaggtttaatggactcacagttccacacggctggggaggcctcccaatcatggcagaaggagaaggaagagcaaagagacttcttacatggaagtcagcaagagagcttgtgcaggggaactcccatttataaaaccatcagatctcatgagacttattcactatcatgaaaacagtatgagagaaaccacccccatgatttaattatctctacctggccccaccctagacacgtggggattattacaattcaaggtgatatttgggaggggacacagccaaatcacatacatatttatttaatgtaagttttacatgacaggtgaaacttcagaaatgaagacccaaagaaacaggaaaatttgcatatttttatgcttaggtttgatgaaaagtggatagtcaagcagataaactgtggagaatttatgaaggcctgtttgttcagattcttcctaatgtctctgtgcatccttctgggtaacagggaggacttttctggttcttatgacttaccttagatcaatccacagatgagtagtaatctaaaagggctggcttctgatgtaagcatggatgctgctaaaagaagaaaagaaaagaaagaaaaggaaagagaaaagaaaagaaagaaaagaagaaaagagaaaaaagagaaaggaaagaaggaaggaaggaaaaaggaaaggaaaggaaaggaagaaaggaaggaagaaagggagaaagggagaaagaaaagaaaagaaagaaaagaaagaagcagatcaagacatgtctcttctacacagtaggtcctgtttttactttttatgcttatatttgatgttgatatttaagtagctttgacaattcatccttcataagttgacatgactcaacagaaataaagaaatgatagattttggggtacgcattttcaaagagaacaccacattttgaatcttaatgaaatgttggaatgtgaaataaagaggcaacattcctagaaggtgaaagaattgtacagagttgaaaagtgtggatcacactgggaactgccagtggctcaattatagccaggcagtggaatctggtgatggagtgggatgaaataagcctaggaggcacaaacaaaatcatgtggggaattcacattctaaactactggaacttacacagacagcccaagaaaagatttgtattttttgatgatctctttggcagtgatagtatgaaggaatgaaatggacaggaggacaactggaggaagggagaatgattgggatgttactgcaacaaagcagtctggaaatgaagttggcctgagataaagcagtggcactcaaagagacggaagaccagacttgagcaaccttaaggagatagaataaatcatgcttggtgacaaatgtggtatgtatgtagtagtggtcgtgagtaaggcaaaggaggaagtttccaacatgggggagcaagttgggttggtgtttgggaggtgagataagaggacagagatgtaccttgttgggggtggatgacaacacccaaggagagaatgctctcaccctggcctcaccccttaaaggtctgtgtgagagcccaaactaagaacggccaagaaaagtgcaaatattccttttctgaacattttaaagaaaaagtggcatattatctttctctaatggcccttcacagatctactgaagggtctcttctagcccttttgattctatgacaactgcctttttcagagttatatgggatgcttggggaattaatgggatatttgtaaagcattttcatttcctttaaagtttttatttacaatccatttacatacatttaaatgcagctggaaaagcatatttaaattcaatttcctttgaaattgccaagggactgcaacagggagaataaaaaaagcactttaatagaggaaaaaagtctacaccccacaggcatcactgtccctttcttgtctcaaaatacacacatatacacacataatcaagtaaaatggtggcaaatcatgctattcttacattaaatttgttaggatcgactttttattttgggggttaagtttctatatttctaaacaactatacgggtcctggtcacatatgttcattttgagaaaaatacattgaactgtgccctatgacttgtacattttctgcatgtatataacttttcagtaaaataataataaccaccaccaaaaataaaaccccacattttaatgatggttatgaattaatctgataccagatgatgacatgatatccaattattgcacagattatattggtcaattatctgaaaactatgactcagggacaggtgacattatgagtagaaataatatccaccaagttcagttaatacatactatgtgctgggtattctgttaggcattagggaatcaacgatgaagaagatggtctctgccctccaagagggcacactccattacaagcttgtccaacttgtggcccaggatggctttgaatgtggcccaacacaaatttgtaaactttcttaaaccattatgagattttgtgtgtaattttttttttagctcatcagctatcattagtgttagtatattttatgtgtggcccaagacaattcttcttcttccaatgtggcccagggaagccaaaagattggagactccttctctattaggaaagacaactataaccaccactgaccacgtttacagagaggtataacttattatcacagcacagagcagccctgattagctttctttggccaggagtggggcaagagtgggccttgaaggtgacatctgaaagagttttggaaccaacagtgcacctggacaaagcagaaaaaaattgcaatcagggcgactgaccaaagatgtgaaggcaaaagcactttaagaggatagagatgcaccatgttggggatgcctgagggaagagccatcgagtagatgagaacactcagggagagaatgctctcaccctggcctcaccccttataggtctgcatgacagtacaaatagctagagtttatggataaccttaagacttggaaccttttttgttccaagaaggtttcttgctatagttgctttcatgagaacaactttagcctgctagaaaggaagaatttaaaaacttggttatttgtttgctttgctttttcctctagctttaacacacagcctgaggtttgtcagcatgtttaacaagagccaagcaagaaagtgaaagagaaggcaaaagagaagggagatggactaaaaaacaacacagcaggggccagtactatttcaagtgtgaatactgaattgtttaacctagaggttaattatcttttaaaaacagaataccaaagttttagcaatttcttctggtatatctggagaatgatatttccaataggggatcagcaaaatatcttggaagaggtatttcagacaagtgtacctagggtgttgagttttctcatgattttagtgggtagagaaaggaaattgactcacaaaaaaaaatgactagtgtttgtaatagagatattccttgcacaactgagaattacgtgcaagccaatggttgccagttctcaagaatatgtaacatatgaggtaaggctgcacatacaaacacagattaagttaaacagtcattcataatgctctggttaatcagaagcccagacttcactgaaacaatgtattatactagctagggaaggcagactggagaggagcagcctacccagcactgttctcagctccagtgaactgtcactagcaaactgatttaaaaaagaaatgaatgcatacaatcaatgcataccttagggatatgtaaaaattattttttaaacaaagaaatattctaatagtttcacccaactactctgctctgcttgtttggcagttttcactaatattgaaaatatgtttcaagctgagtaaatattctggaatgatatgaattgaaagtgaatatttctaatcactagttcatacactaattttctttttgcactctcagggtgttctttttaaacaatgtttacatcttaaaaacagcaattctgtccatgttgtatattacatttatttcatgtttatttttggtcagtaataatattacctatttagcatgattttattgtatatatcttttatattcaggcagctttaaaaatattttattttttagtgaaaaacaaaacatcaaacaagtaccaacaagaaaaatataagccagctgggtttttgtttgtttgtttattttgagacagagtcttgctctgtggcccaggctagaatgtagtgataacaatcttagctcactgcaacctctgcctcccaggttcaagcgattcttgtgtctcagcctcccgagtagctgagattacagctgtgcgccaccatacccagctaattttttttttttttagtagattgggtttcaccatgttggccaggttggtcttgaaactcctgacctcaagtgatctgccagccttggcctccgaaagtgctgacattacaggtgtgagccactgcaaccagcaccagctgggttttgaatagtcaccctcaagactttaaccctgttttcacattggaacttgatattaaaaggtgagagttattccagatcattatctccaaaattctccttttctgatcagagacatttcagctacacaataagttttggaggaatttgtttaaaaacagttcctaggcacctacacccagaaattctgattcagtaagtctggaatgaagttcataaaagtattttttacagaagctgcccacttgcttatgacacatagcaaggtttggaaccactgacagcgtatttctcattatgtataatttataatttaaatagtgatagtttctggcttgactcatcattttcctacaatgactgacaaagagaaaaatgaatttatgttttaaaaagtaaaaacttgaactaccatcacccacaagttataaaatcataatgagatgcaaaaaattatgaatatataattacttggaaacattcatttttgactcgttttcttaggagcaaattgcttaatgctgcatacaataaaaataattcagataacatcactaagctgcaaagaagtcatatttggctgaaaatgactgagaaaataaccacaatagcaaaccaaactataaacaaatatactaaaaaataactgattgccaagtaccaatatgaaaaaaaaattcagtattattcgggatgatcactgaaacatgtgcacttagggaaggattttccagacaatgtcctggtaagacttgactctggcataaatcaagagggaatgaatctttcaataaatatttatgtgacttacagattttgcatctaggtattttaaatcagcctgtttacacccgtatgttgctagaatggctcatcagccttcctgggagaaaggtgaatggatcatcatgagatgtaactccttcaaggttcctttatttaaaaggagggacaaggcatgagtggtttaagtaagggttaaaaaatgaattttaaaattcaggtcactcattgccccattctcccactggagtgtattttcaagccatcaggtcctgccttggccactgggacctgagaaatatcaagctggaaggagagggccatataacctcatgagcacccagacaagatttcctcttgggcttcagttacatcctactatagaggcactctctcctcaagggggcaatgtgtcaaatttgaatgacatctatgactgcattcttctcacttcaggaagtgactgtcctgctgtccacacaagaatgacaggagagccattttggttcctagatttcttttccgcatagtcaactcttccttcctaggtaatagttcttataaatgccactacaatcaagtggactgattctaaatgcctgcaggctctatgccttccactataaattatttgagaatgctatgtcttggcccaaatgaggttagctagccagagcatgctgcaccactaaaagcaaaggtctacaaatcatgcaataagataagtggttgcaggtttttacactggaagactatggaacagagacagcagtggctctgattctgcccctggaacaacgttggtagagttccgggtaccaaaagagctgctttcctgctaagtttgaatattatgtacttgtagaaagcttcttgatattagagcactcctcaacctacattccagttttaggcccttcagatctttggtcattagggaaaagaactttggcagagtgacggcggaatatctactctagttctctagagggctgctgtggcttgatcattacggaaatctatcctaccagttctcatgcaatacattgcaaggttttgtgaaaacacaaatactctctgccaagaaaaaaatggatgtgcagcctcattgtaaagacattttagacttcacctgtgctcagaaccctatgggagacccaaccatgtttctggttgttaatagtctgaaacaaaatatcattattgatccatttgtttaaaattccagtaaaataattagtcattaaattagaatcctcctaacttgatttttctatttgtaaacaccttaagaggcagcctttactttcattgctacaagtgttatttacaaatccatttttcttcaatcagctgctgtgatataaatgtatgcaacctgtaaaaacttaaattgcttccttacacctggatattcaaccaacctctagatgtctgtaattgtatgaaggaaggtgtaaccatatctaagcattttatattagagggggccagaagccacggttggtggtaatctgacagcatctcaatctctgttgactgaggaattaagagtatttctgacattttagagctctttcatcatgctgagcacacagtgtttcaaaagtaaagccaggtcaggtgcggtggctcatgcctataatcccagcactttaggaggccgaggtgtgtggattacttgaggtcaggagttcgagaccagcctggccaacatggtgaagccccgtctctactgagagtgagatagttagccaggtgtggtggcatgaacctatagtcccagctacttgggaggctgaggcaggagaatcgcttgtgcccgggaggcagaggttgcagtgagctgagatagtgccactgcactccagcctaggtgactgagactctgtctcaaaaaaaaaaaaaaaaaaaaaaaaagtacggccgggtgcagtggctcacgcctgtaatcccagcactttgggaggcagaggcaggtggatcatgaggtcaggagatcgagaccatcctggctaacacagtgaaaccccgtctctactaaaaatacaaaaaattagccaggcgtggtggtgggcacctgtagtcccagctacttgggaggctgaggcaggagaatggcctgaacccgggaggtggagcttgcagtgagccgagattgtgccactgcactccagcctgggtgacagagcgagactccatctcaaaaaaaaaaaaaaaaaaaaagccaaatattttaaagtagatgacttaataaaataatcttttattatatccaatagggcttatgaaagaatatctcagatatataattcacaattttatatgcaagataccttgcatataaaattcacaaataagaagtatataatattttaaaaatagtattatacagttcataggtatttcttaaaagaaaaaacaacaggtcttagaaaatttcaaaaaataaatttcaagttttttctccttagaatttatggaatggtatctgttttaatgaatgaaactaatttgtttagtgtttgaggcacacaagtgatgtattaggatcaccatcatcagaaactaatttatttcagggcccttcatgatactctgttagctatctccctggaaagagcaggacaagtgatacaaacattaaatatacatggagttctttcaaggaaaacaaaatcacattgagttgaaaccttccttccctcttggtcaataaaaagaggaatctgtggtaatgactgggtcattgttattactgattttgactctctcaatacaaaaaaacataaagcaatagtgagaaatagcttgatataacaagcctacaatattagttctcctgaattttaagaacatttcagccaggatgcactatcagtctactcaattagaaggcacatacgttaaatttatacctaaaaaactaccttgaaatttattgctatgtttacacaatagctggttttaaaaacctcatgaacttgaccatttttatgggccaatacactttcaaagggaggatataatagtataaatagtacctcacatgtttcttcttaccatgataataagttttttcatctctaaatacctacagcaattaggttttacaagaattactactttccaggtttaagaacattttatcaaattaaactagcatgaaagatcatgcaattggtaggtatcactttgccttttatttttcaaaagggtctgctctcgtttatgttgagtttattttcagcttcaagtcacttttggcagttaaatcataagtctttaaaaataagagattataaggagaggagggagttaccagtacaaactgaatctaatacctgtgtgaattacaattggttggttccaaccaaatgaatatttttaccgtaggccacggtaatgcagttttagatggaaataaaaggaataaccgttgatctgtctcctatagcctctgggcattccaatattgagttcaggcctggataaacagttgctacgatatgcctagcacctacctctgagggactggtgtcaaattaatctccatgtcatcagtaccttctcaacaggttttaaacagtcttctctttccctctcccagatcaacagttgtcagggtctgagtcaagctgtgcttctgcccacatagtggcactgtcagcactgtcggctgctcaaatgattttttaagcagagcagccggttgccttcagcagcaatgcttttgggggcactgcgtgctgttcacccagagtctctggctgctctacaactgtgctagttaagggatcgacagaaggaacaacaaatggctacaattagcattcgccctgctcctgcaaaagaatttcattgctatggcaacgggagttgcccagacaacatagggctttggctgagaagagtgtactgcgttataccaagtatggaacaaaatagccatagatcaggctctcgcttcatggcacaaagatctctgccatcatctttaagtttaattaacaagaactgatttcttaattctgggagccaaggttctggctgttaatagcctgaaacaaatatcattatggatccattcctttaaaattccagcaaaacaattaatcattaaattagaatcctcctaacttgatttttctatttgtaaacaccttaagaggcagcctttactttcattgctacgagtgttatttacaaatccattttttcttcaatcaactgctatgacataaatgtatacaacctgtaaaaagttaagttgcttcattacacctggatattcaatcaacctctggatgtctgtaattgtatgaaagaaggtgtaaccatatctaagcattttatattaggagctacaatcttgcaggtcttctaaataattttacatcaaacaggagaatatctattatactgtttttgaagtaaacttttaaagcaggaaactgaaaacatcttgaaattggtgtggtaacagtactacaagtaaaatggaaaaattaatcaaatgacataaaaatgggttacctcagccaccattcaatacctctgcagtcaagcttcataaattggtccagtgccactcatagtcatgtaaaacattctatggatctgatccagtaacacttcttaatgagccaagaagcaggatatattcacaggcaacacaggacaatggggctagcaggtataacctggcagatgacagtggtctaaaattttcaaaacttgaaacatttccagagtacagtctctttcccagccaatatccttgttagtatagaactaaatattatcatcagtaataacagttaacattttattgagtgcatagtgctttgcatggcttgtttaatttagttttcacaaatactctataaggtaggtataatttaaataaggaaaccgaggtgcaaagagattcagtaactgccagcatataaacagcaaagctgggattcaaaactaagtagacccctatagggttttctttacttcagctacattattagtattgtaccacaataagcaataatgtagtcaattttttttttttttttttgagacacagtctcgctctgtcacctaggctggagagcagtggtactatcatggctcactgcaatctcgacctcctaggctcaagcaatcctcccatctcagcctttccagtagctgggactacaggtgcacaccagcacacccagttaatttttgtatttttgttagagatggggtttcgtcatgttgtgcagggctggtctcgaactcctgggctcaagcatccccatgtcttggacttccaaagtgctgggattacagacgtgagccactgcacccagctaatgtagtcattttaaagcttcagtctcttttaaaacaagggtaagtacaaattctataatgggaaaggtctaaacaaaaaactcttagcatgtaagaataatatttaatttaatcattcaaatttcttaaataattatctggggatgtgggtaagtggggaatgaagagagaatgaaacacattagctagttctggttttggtataaaatgtctgaatatatacatgtaaagtgtctgaacagaaattatctctcttaagaacacatgtagacatccattttcattttataaaagattatttttaaaagtaaactctttattagtggtaagtagctactaatgaaaattacaaatattttactctctggcagaaatgattctgctttccagctttttaaatactatctggatagctcagatcatactgtatttttagctctgaggctaataccaaacaaattgggttaaagaacaaaagcagaaataatttcagggttaaaaatgatttttataaatagataaacttgatgaagcctaacttttgtcaaatctattagtaaagggcaaatattagaaaacttttcaagaaattcgatatctgaggcttctactctgatgaatcacagatatttatgtaattctaatttatgagatcaagagtgtttataaatcactaaacttcagacaaaatgtagctggaagattttcatgactccaaataatatagtaatacaaatctgaaaaatatgtttttgttatactgagttttttgggactcaaaagtgtactgcatgggggaaaactgctttgaacatgtttgagcagtagcagtattgagatttttgagatagaaaagcagatatcctctcgtgacactgcctaatggctggtattttctgagtaatatctatattttaatttttgatcataattatacttgtcacttacagtgaaataaacacattgaaacaggtatatacaaagaaactccagaatagttgtgccttccatccaatttgttataaatatatttcttatgcttatggatgttttaggataatagaagcagaattgtaaaagtgccagcaatatattaagatcaaacaaaatatggtacctgaaagcactctgaaaactgtaaagtgctataaaaatgtgtgtttcacaaaaacagcgttagcttttatgggctcaaagagatcacccttgacatttacttattttaagtaaatcaaagaacaaaagaagataaagtatataaattccatacccttctaacccaccccttctaaaaccctcatctaggccatctccagcctcctcctactgggacaccttcactttttagctattcaaccaatttaaatacatgctaaactgaagagaaatccctcagctgattgttcccatctaatctgtcacaaaacagccagggagtaaacacaactcctgtatccaacttatctttctgctctctacttctgatatttttgagggcatcttctgttccagaaaaagtaatctcctgattccattcaaagaaaggcaatttactgaagtgacttagaaaatggaatttgctgtcacagatctgggtttaattcttgcctctgtcatttatcagctttacgattttgggcaagttacttaacttttctaagcctcagtttgagacaatgcaaataatacactcaacagcgtctgacacgtagtaagtggtcaaatactagctactttattctttttggcatcttatctttctaaaatagactcccactcctctcacctcttatgtctggggcaatctattccctccgctctaccatttagcagtaaccaacttgtagacagaagttctgagtttgtatcctgactctgccacttaatagctataatgatctgcaaaagcaccctttccaattacaaatatagcaaattgagaatgaaaatcgaaactgtttacttacagaaaaataagctctagtttgtaaaaatggaaggttccacattagcttaattagtcactgaagaaggtagatctgagactaatcatccttttgtcacttggattattatcagtcttgtcaaaccaaacctaaaatacttcctactatcaatttctcatttgactcttaatttacttgaactcttgctatgtgctaggttgtactgataagttttcatgcattactggattttaagcctcacaaagaaccaaggctggaatgattatggtcccattttactgaccaaaaaacctgaggcacaagaaggaagtgacttgctaaaggttacacagctagtaaagtggcaacctacatcattaacttcttttctatacaggtatagtaaagatcattacagacctatgaactatacgttcaatgtttagtttttctgtttaaatgcttatatgttctgtattgctcatacagcttatgttatatacatattctccttagagttcaaactacatggtgtcagattcagtacttattttcaattatttagaagtcacagaacttgtttcaataccacacaacttctaagcactaaataaatgttcattgataatgaagaaaatgtgcacagccagggcaaggtcaaggtagaatcacccacatggtggaaataatttgcaataaaattataaaatattaaaacttaatgagcacagtctcaattaggaaattgaaaatctgctcattaaacttgcagatgatacttagttgggcaggggttaaatgctttagaagaaatagaatttaaaatgaccttgatagattagagaaacggttcatcaaaaacaggatgaagttcaattaagagaagaacaaaatggtatactcaagaaccaaaaacataccacactgattaaaaaaagagaatgagtggctaggcacatggatggaaaaaaagccacagatgaaacaatctgttacttgttggcaaaaggggctattttttatctttacctatcagtggcttacaattttgttttgcacactgaaatcacaaagagagtttcaaaaaaatacagtgcccagaccccatcttagaccaattaaatcagaatgtgtggagctaaggctccatattggagccattagaaaaactctctaggtatttctaatgtggccaaggttcagaatacatatgaatatagaggataatatacaggatatgacatagaattaatcatatcctgtacagccatataatgagccttataaaaataatagctattattatgatcagacactgaaatatatggctcacaaagactaataaaaaatatgatattaatcaatgatgattccaaatactcaaaacagataaaggtgatccagatcttgtggttctcaaagtgtggttcttgtatgagtagcacttgggaattgagaaatgcaaattctcatgcctaccataaacctactgaattagtaactctgggttgagcccagaaacctgtattttgacaagaccacaggtaattctggtgcatgctgaaatttgagaaccaaggctataagctaagaagccaactttcttttcttatagcatctgttttctcttataattacataattattatgtgtctccttttgtaagccatttcaaattcttcctagaaataagtagggtatataaacataaactttaaaaaagttataatctactaataccttcactattgaaataccttttcttaaatagatacatgtggtaaatttagtaaaaaggaaggaaggaaggaaggaaggaaggaaggaaagaaggaaggaaggaaggaaggaaagaaggaaggaaggaaggagggaaggaaggcaggcaggcaggcaggtagtcaggcaggcagggagggagggagggagggagggaggaagggagagagggagggaaatctgctaaagttgctgttaaaatagcctggaagagaacttaattcattggatggcatcatgtagactaaggttagtcacagttagttttacagatccattaagctgctacctcattacccaaaaaccttggggaaggaggtgtgaacccatctgaggttccagctatttcttgccactgggatttaggtctgtctctgattttcattcacctatttccaacccattactccagtacatcagagttaatagtatttattatcagtaatgataaaaacatacaaataaaacctactcaatggcagcattgaaaaatcatcacaaacagtaataataatttatcctaatagagaaaaaagaaagaggaaataataatattgaagtttctgatttttccttaaggatgacatagtttgctaagaaatactgagaaggttctccctcctactccgtttctggttcctttgcccccttaattttatcagttacaaataaaggatgaaaatatatgcaatttcacagctaaagaaaaatgcaaaacaataagacaccattttgtcgatagtaaaaattctgagacacatccagtgttattgagaattagatgaacggacatgtccataggctgctggtaggagtataatttagtataatctcttcactccacccagaccagtgaggcaatatgtataaaaagattcaaaattgttcatatctgttgcattatcctgaagaaacagtgctatatataatggtaaaaaaaaattgaaaaacataaaagccaaaccctacctaggaaagctagttattatgggtcatccttttttttttttttttttttttttttgagatggagtcttgctctgtcacccaggctggagtgcaatggcgcaatctcggctcactgcaagctccgcctcccaggttcacgccattctcctgcctcagcctcccgagtagctgggactacaggcgcccgccaccacgcccggctaattttttgtatttttagtagagatggggtttcaccgtgttagctaggttggtctcgatctcctgacctcgtgatccgcccacctcggcctcccaaagtgctgggattacaggcgtgagccaccgcgcccggcctattatgggtcatctttactacacagccatgtcatgcagccactgaaacactgttaaaagagtacatgctacaaggacaatattcataacacaagtggcagtttgacatgtgttgtgataaaattgcatcaaaatctattcattctcaatatgaaaaatgatggtgagctaatggaaaaatgggcaaataaaacctactcaatggcagcattgaaaaatcatcacaaacagtaaattgatcctaatagagaaataacacacaggacagacttgaataagcacttcacataataggatacccacaaaagcaaataagcctatgaaaaggtactcatattatccatagaagaaatgcaaatcaaaactacactgagataccctacttgaattactaaaactctaatacctggcttttggaagtataaactggtacaactattttggaaaactgctggacagtatttactaaagctgaatatatgcatatccaacaaaacagcaattacactcctaggtgtatgtctgatagaagcaaaagacatacataataaaaacattcttagccatgttatttgtaatggttcaaatctagatacaacataaatatccactgataacaggaaaaaaatgtgtgatatgcccttatagtggaatactaaacaatagtaagaataaatgaattacagcttcatacaacaacatggatacaaagtgtacaatcctatttttggaaagaacaaggtaaagctagtttatgctcagagtcaggacatgtgtggaatgtgaggtaatgactggccacggggctactgtgtttctaattaaattctgtttcttgatctggttatacaggcaagctcatttaatcaacattcatcaagccatatacttaggatggtttacttttccatatgtatgtgattctatcatataaagtttacatttaaaatgaaggaagaagctagggagtatatgggaagtttaaataaaataaaacaaaacgtcctaaatcaatgcaatacacaatgccaagcaatttagtgaagagggggcttcacagaggcaagaattttctctctcttttttttttttttttaagagacagggtcttgctctgtcccttaggctgtagtgcaatggtgggatcatggcttactgcagccttaacctgttgggcttgagtgatcttcctatctcagcctcctgagtaggtgggaccatgggcgcacaccaccagaactggctaattttgaatttttttttttttttttttgtagaaacagcatctcactatattgcccaggctggtctcgaactcctgggctcaagctatcctcctgcctcagcctcccaaagtgctggggttacaggcatgagacaccacatccagaccagtgatagtcttttatttctgattttgaaatagtgcttggcattttttgaaagaaaaatacctttttcacatgattaaagaagaccttagtgcaaaaatacaaagaggttatagatagaactggagatctgtttagaagagcatgtgatgaaccatatgggcctacaacacaaaaaagcaaactttgaaaaatacataaggatgggcccgggggcacagaaactaccacaaggagagtggtatcagcaggatatgaaaactaatcacaaataacttaaaaaattattctcagaaccccttttctggttattaaaacaatatgcagaagacacagagttaatttctaggaaatatcacatttctacaacatagtacctagagttactgacttgtattacttcatcccatcactaaatacatttctttctcatcctcagcagatcaagactgcttatatttaggcaaggaaagggaacggggatcagtaaatgaagagaaagtaggttaacagaatgaagagtaataggcggtgttcagcttccagtaagtgagcagcaaacagagacaccagtgtttaaaaagtgatgaaagtggctgggcacagtggctttgggaggcagaggtgggtggatcatgaggtcaggagttcgagaccagcctggccaacatggtgacaccccatctctactaaaaatacaaaaacattagccaggtgtggtggtgtgtgcctgtaatcccaactactggggaggctgaggcaaggagaattgcttgaacctgggaggcggaggttgcagtgagccgagatcgcgcccactgcactccagtctgggagacagtgtgagactccatctcaaaacaaacaaacaaacaaacaaacaaacaaacaaaaagtgatgaaagccttgagacttattagagaggctgctattgtcaaaggctgcaagtgtagaaacaggtcctaggcgctgtctcaggcaggacttttctctgccctaataagactgtcagagattttccttaatgcactatgcccttcacttttttcttctggcatattaaaaaatagagcatacatcatcactctcatttgagaagctgcctgataacagataacaaagaattttaaaagatctttttctttatattttctcctcctttcgtacatggggaaaactaagaaaaagttatgaaatatgctttccatccagtgataaaatagcactttggatttaataaaactctgttcatggtttatcaaatatcaacttaacaactcttcagagtaactatattaataagatgtgagtaataaaagaactgataataaaagtttcttagttgtctcttatatttgtagccttgaagttacacagattttgagttactggcttgtcagagctaaaatacaacaagatgttttaacattttaaaatcctaaaccctaacggtatttactagttcatctttccatgtgaatatgttggtaaatgtggacttcgttgttatttgcatatcatattagcattgttctgctgcatacatgctttaatggaggaaggtatgcaaatataataggcctaattatcttatctcaaaagaaaaaatgttgtcagacttttttaaccttaaggtggcaatacaaactaggtgagggtacatacagtaatatatgaggtaaatgagtgatgcgctattgttttctttggtatatttcagtgttcctttgtttcattattcttctagaaattgtaataagacagctcctgtgactaattaacccaaagaggtttgactaatagaaggagattgcaagcatgattacttaaatgatcatgtacatagcacttaatgatcattatcatttattctaatattagtgctaataaatggtaaaactgtttaagccaaatgctgtcacatcacaataaagtacatcatggctaacactaataatttctaatttacttgggaatcaatgagacattatagcattcttaatgcatgtcaattcttgcttcaaaaaatttataaaccctttaaaagcataaaaatatttagtatttatctctttacctagacgaaataacaaactgtctaaccatcatttcccctccaaaccacagttccagctatgctaactacatccctggctttcatgagatcagtgtaatacacgaaaagtcacttctttataaaaaaagtcaacgattataactaacatcagtgtttcaaaatgcgaatttcatcctaccctcttgcttactaaggagtcagtggatacacattatctaccagagttttacacactaccagaagggtacctttgctctaaaaagtaaaaaaaaaatgtagagtggtacttgatttttctctattgctcatttctatcattttttttcgcacattaagaatgacaagggaagaaaataattcagaaatgtgctgcaaaatcactggtcaatattatctatacaacacaaaagaaaaggttggaagggtgttcattttatatgcaaaagcacatttattatcctgagctagtgacactaccattattgactcctatcatccctatcactccttaggagtgtacactgaagagcattttagtttctggatcacataaaaatgataagctgagaggtagaacagagaaaattcctctttaggtttatatatagcattggaagacagaaagtaaagagaaataatgcaaaataaaagtacaaccagtgtattttaggagaaaaggagatagataactaaatgaaagaagagatttcggcttctggttatatcttaatacagataaacttagaagctcagacagctgctagatggaagctccagttccttacaacttgggtttctccaaagggctgctcaaaacatagtgtcccccatagccaaagaagagggagagagaacagagcacccaagatgaaagcgtcagcatcttttttttttttttttttttttttttttagacagtcttgctctgttgccaggctgaagtgcagtggcgcgatctcaactcactgcaacctcttcctcctgagttcaagcgattcccctgcctcagcctccggacgagtagctgggactacaggtgtgcaccaccacacccagctaattttttgtattttagtagagacggggtttcaccatgttggccaggatggtctcgatctcctgacattgtgatctgcccgcctcagcctcccaaagtgctgggattacaggcgtgagccaccgcgcccggctgcttcagcatcttttataatctaagcttgttagtgagatacatttctgccatatttaattggaacaatgtttgaggtgggagtggattatataaaggtgtgaaaaagaggcagagatcattgggcaccattttaaagtctggttacaatgtttctattattatggcaaagtaaaatagtatctaggactatgccaagtagtgtaccataatcatatatcacttgtctttttttctaaaattaataattgcctattgcctcttttttttttagtgtctatcattatggtggtctaaaatcgtcccggaagccttttaatacaattgtacaaatgatcattcagattaattgtaagattcacattttcccctgatcttccctgctatggtttgaatggctgtcccctcccaaactcatgtggaaatttaattgccatcataatagtattgtgacatgagaactttacaaggtaattaggccttgaggcgtctgtcttagttaatgggttgatgccattattgtgagaatagtttccttacaaaggatgatgagtccagccctgttttgtctcccttagcccatcaccatgggaagatgcagtaagaaggccctcactagatgccagagcctcaatcttgaacttcccagcctccagagttgtgagccaataaacttctgttcataagttacccagtctgtgtaatctgttaaaacagcaaaaaatagacaaaacaatctccaagaaccctctatctttatgctttttcaaatattgtactatttttttctgctaccttgttttccatatccaagggatccttgtttcctaattctttttcatacatatatctttatatatgtgtatacatgtgtgtatatatatacacatataagtgtatatacatatgtacacatatatacatatattcacatatatgtatatacatgtgtatatatgtatatacatatatgtgtgtacacacacacatatgtgtatgcatgtatcctgttcctttcatcattgaaatagtcttttaggctgtgcatggtggctcatacctgaatcccagcactttgggaggctcaggcgggagaatcatttgaactcaggagtttaagaccaagctggccaacacagtgagactctgtcttcacaaaaaataaaaaataaaaaaattagctaggcatggtggtacgtgcctgtagtcccagctactcgcaaggctgacgtggatggatggcttgagtctgggagatcaaggctgcagtgagttatgatcataccactgcacttccgcctaggcaacagagagaaaccctgtcacaaaaaaaaaattgtctttgatatccctgaaattataattgtggtgttttgcttgaaatttttcttttgttcttcatattttctctttttattaagaggtcctttgtttttccttttttctccatattaaatgttttcctcaaatgttagctaatgaatctgtggcccaaatcaatatttaagagtaaacattttgtgtgaataagtaagttggttaactaatgggtttctctgtgtaattctcttgctccgagctagtactgtggggaggagcagagtagtaccagaaagcctgttctctagactgttcattatatccagagatgtattctgtcatctgcttggagcataaactttgcttctgtatgctaagaactaagtggcaaaagggagttagaagaggctttttcaattcatttccacttttttctccttaggtcatcttctgtgtttacataatccctgtttgcagtagaacaccttgctcctgcttcatattcccattctagattcttgagcgcaattgttcctaacaataaatctctgatctcctggaagggtgggagaaagggaagtgaggtgaggcagtatagcataatggttaaaattctggacttcggagtcagactgtctagatggtggctgaactgctccttttccagtcccattttcagctctatggctcactagttctgtcagcggttcctggcaccaataattcctgagccctcagagtcctgggagggatggatcagtccatttgccactggggccctgtggtgttgtggattgaactgtgtcccctcaaaaaagatatgttaaagcccttacccctagtacctgtgaatgtcaaccgtatttggaaataggatctttgcagatgttatcaggtaaactcagggtcatactagattaggttgagtcctcatccaatgactgatgtccctataaggcagccatgtgacaagttaaaggacacatggggagaacaccatgtgatgatggagacatacactggagtgatgcagctacaaaccaaggaacaccaaggaccaccagcaatgactagagctaggagagaggcatggaatagattctcccacagagctgccagaaggaaccagcattgccaacatcttatttcagacttctagcctccagaattgtgagagaataaatttttgttgttttcagccttccaatttgtgataatttgctatggtagccctaggaaaataatacatctggattccagctttccactcacatcatcgttttctccatccttcccatgtctacatattgttgttccagattaaagatatcttgatgtcacaggtgctgggaattgtttttgtaactctttctcttggtggctctgtggtgattgactcccagggacaaaaggaggtaaaaacatctttattattctattttaaaaacaaaattctccatagtcttaattttcaacttttttctgctaaactagtttatattacttccggtattttaagtacagtccaagaactattcatagcaagaaaattaatttccatgtctccaattactaaatccattctatgtgccattcttgttgaaggatttgcaataactttctattggcaaatgtatcatggaaggaaagtgaagaaggggaaggaatgagaaagtgccagcgtattttgaatttattgagtagctactcaattctaggcactacatcacaaatctgggcaccttcatacactttcatttagtcttcctaacagcctatgaaacacatagtgtaattcctcttcttatagctgaggaaaagaaaacttaaagacaaataaccacagtcaccctgatagtaagtaaagaatttaaaccagacctgtttgacctcaaagcccaaacctgactccgaactgtttttcaaggtcaaactgctctgccagaccattcacttgtagaaagagtatttgaaaatctggctagttttatgctttcacaaatagtcactgaataaaaacaactactgctatttttttttaaatacctactatgtgtaaggtattttgcaaattatttatttttaatactgacaggtggtttccatatctgtggctacttggaactgacctttaaggagggcaaataaagtaaaatataaatccaatggtatcttataaataaataccaagtgttgttttcttagaaaagatttcagacacataatgcagttggcacatgcctggaagaaactcagctgcagtagggtcccccatccctgccataatgcctactacagatggaatacaacagcagaaacactggtgaaccacacattgttatgttccaaaagagttttcattattttcctgtaactactacagttttcaaaacacaaaatatcttatcctatcagaaaatttgatgactctgcttggctggtgctctatagcacacccagtctgcctactgcctgagcattgtggtcacacgtggtgattactttttagaacctttaggctgctggggatcatttgccctttttcacagggcccgggaggcaccttggctacttttcttaccatggatttcacacactatactatcactacataagtaatcatctccctctgcaactgggccattaatgtaaaaattattttgtgtctccctgatcactttcttctgacattccctagagatctgtcagccccaatgaccttgcctccttcccccagccagagactatgactttaaggaagagatcttatctcctaattctcagagaaaacaggtgttatcagatgggagctcagaattttccctcaattactgtctgcatccacttctgttcaaacatccttcctttgtaactgtccaggtgctctgcacctatgctttcatatcccattccccgggaacctaacctaagctactgctcccctaagtcttagccccacacctccagaactattaatacttcctttcagaatacaaagacagtaaagcctttgtcatatgaatggcaaagaaacataatatgctcattaaatcacaaaccatttggttcagctattttcctactttttcttttcttcatatctaggctttcaaaaaaaaaaaaagaaagaaagaaagaaaaaaagctccactcctcctccagccaaggctacctggcttcagtttctaccaatactgcgtttctcaaggtaagcagtgatacccgagtccttcagtccaatctgtgctcgggtgcttatccatcctttttgtacctggcctttctgaacatgtggctttggtgactattctttcccaacttctttgtcactggtggctcctaggggagaacgctcctcctctggcttctctttctctttcttgctccttccaagttgtatgacccagatgagccctgcactccttccagcttgagagatccagtaagaccaaagactatcccaggtacacatgacgtcatttcctctgtatgctcagtgaacctccacagtagcaccacctcgttggattgtaactgtttaggttaaacaatttatttgtctctaaaactgtagattcaccaagaatttgacatgcccatgaaagtttagttctcaaatggcaaacaattattaatatcatagaaatggcttcccttttaagtaatgcaaaattacacaacacatagaaacagagacaatgtgtaacaaatcagtaatcaaacgacaaaataagtaattctttaatcctcttttaaaagggatttttattttgggagaaatttgaggaaaccaacatatccttttaccagtttttttttttaagtccaaacacaaaatttaaaacaaaagtacagagttcaaggagcttctaaagtctgtccattgattccttataaacttagactctgaacttttgccataagaaaagggagagattcagaatgggcaaacgatttaaaaagatcataataattatagtccactatggaacacaagcagaacaagagatattaatcataacaaccatttcagggaagtcaaggacattactttccttatacaatacagttctttatctccttctcactaaatttattccagccttcagcatacatttgtgaatgctcattaaatgaaagacatttgctatttcttgcataaatgtccttttaaaacaacttgaagtcttcactacttgagacttttctaacctgttcatgcttaagagtctgtttgataatgactatgccaaaaggttgtcctgccctgactataaattagataagaaaagcctttcctgtctacccacagggcatccttacctaggcaggagccctgctgagtccattctgccttttgcttgactacatggtaaatataagagactgatgtttgaataaactgtgaaatcatccaaattattttacattcctagcctaaaaaaatctccttaaaaaatatttaagtcttttgacagctacaggtagcatttgattctgcttgaaagcccaagtgtaagggtgtcaaaaaccattagtattttaatagctccctttcttaggttatttgtcaggcatgagttcatcaggaaaagaacaaaaaatactctcaaaaaataggccaatgacatttagaaaatcaagttattttaatatattgttccttatgctctttctactttaaaataagatacagttaaaataaatgaaaatggtagttgtcaacatttactacttcaatagagttgtcttcattgtttccaaagaagacttaaggcagttagtgctcagtagacaccaatggaaaccttagaaatttcctaattctgcctaaagacaaactcttgctgtttgagaaaaggcaggtcaagaaacaaggtgtcccaagatcgagtggattggggatgggggaggggtggctatatatgaagttttgatatatcaacaacaaagcccatcttgtgtgcctcccttagaaaaatatgctaattcaaagatatctaaccagcttcacatttaactctgacttcaaatcagagtggcagagcagctgtgcctggaggcaatacaatcttatttctataaaaatctctcaaagtgccatatataagtggaagagtaaaaatagataatcaaatccaaattaaggctattaagaattgatttagtgtaaagataatatagcaagattttgtttaggttatggatgctctctaaaaatgcataatacttgtttgcctaaaattttgattatgttttatcttattttgtcacagttaaatagttttatctttaggggttttaattgcatatagtttatagaattctttctgattactctctatccatttaactggaaaaaaaatcccactgtaccacttatgaaaagagaaccacctaataaggatgcaaacaaactgcaggcagatgcagcataaggtgtggttcaacaattcatatctgtggagcctttatcacaaaagttttacagacagttcacagagtgtacagtggaagagaagtccctaggagagtaggaattaatgtatcctgaaaaacaccagtcactcagtggtataccagaggttacaaagaaaacaatcaagaaaagaaaaagaaatgagaaaaccaaagtcttctttcaaccttcgttgtataggctccactactgtgtaattcctcccaacttcttgatctcttttctgcttctccttcacttcattactcacctgactccattcctaaggttcagtccttaacttgccattctcttgttttaaagattctcctttagataactcacttgcttatgaattattagcaattctctgtgggggtgtcttaacctagagctctaggctgggcctctttcctttttgacttttttttttcttcccctctttgacttttccccatccatagcagccgattcatactggcatataggttgccatgaagtcctttcaatccctccctctcacttacactttagttccatactaactatggggacctgtcattttcatgctcaaaaacctcaacaatccaaattccttggcctggtgtcagacccgcaatatacttcttccccatctggtaccttaaactgggccagctgatttcttaacactcaaacaccatactatgatatttattaaaatgcattaataaatattttaattatcttgatttaaaagaggagattttactattttctgtagactacagaaaatctttaggtttggactgtgttgaataaagaaaatagataatgccctgtactcatcaacaaatacattcttttgttttaatgttgccacactttgcttgactaagggaaagatatttaataagtagccctccacttctaagaagtgagtaaccaaatcgaaattgaatctcccctcccctacatctgatccgacaactctttgaagctatgcatagaccaaacaatcaaatatctccttttgatgatagataacttcaagggaggagatgggaagcggttaactgtgttcacagctggaactttagcaactggcatatcaaattatttgggtgacattaagagatttgattttactccttaatatgtattaacagttccattcaagtataaacataaacatgtctgttcattcaacacattcttataaacacttacatgcctgataccaatccaactaagtattggggttacagcagtcaacaagacagatatgctcctttatgccttgtctccactctgatgaaactcatgagtactgtgacagacactgaataaaaacatcttcagggcagtgtgtattataaaatgggaagactagggtgttactagaatgtacagttctacaaggttcagactggggttcagaaaggacctcctgaaaaattgcatacatgctactactgctgctgctgctaggctcactcttgcccttgggttttggcctcatttctactcatctttcaagtctcagcttgcatttcagatcctttctggaagccagctctaaactgtcctcatgaagtctggatcagtctttctgacttcctggtcttgccaaaattttttgttgcctctaacctggcatttaccaaaagtagggcaattattactagtctgtctttcaactagatggtgcattcttggaagatatctataaatcttaagtgcctagcaacagcttaataaattttgctgaataaataaagatttagcacatacttcatttctgcctgtgcctttacagccaaagcaaaagataacaggtacaacttgtaaccaaagtgtttttggtagaggtttggaccacagcacaaaggctggataattcagtgcatgagatgtctgcttctgaagtccactgaagttagaatgcttgaggtcagtttgctaaaatacatatagggacattttagccccaacgtccaggaggatactttaccagaatttttttctattctgagagaaaagatgctctctctatatataaaaagaaacctaagaagtctgagactatagctatgatttaagaaggcacagacaacacacagacagcaaaagatatacagacaataaaaaattaaaattgcagctaataaactcaaatttaggctttggatatatattttttacccaagctttctataatatttctaacacagcataggtttattaaaattaacaaaaatgttttaatactgagtttattaaaataaataaaaagtggtcataattaattccagattattttcataatccaaacctcagactaggaaaacagtgctatctagtggctaaatttgggaagaagagatgaggcacaccagaggctggagaacctctgagaggctgtgtctcaattgtttaactttatgttacaagctaaaaaaatgtatgcatataagtcaccagctcatggatgggaaaggaattagacatggattcaagcagttatattaagagtatggcatggcaaagaaagtaacaacttggactctgaagtcggataggcatgcattcaaaatttgactacgtgcccttaaacaagttatcagacctctttaatacttgactagtttcgactatgaaatggagataaaaatattgactctctgatagaaatatttgagaaggttaaatgggtaatatgcataaaatattcatcatagtgcttggcatttagtaagccaaatatctcagtaaacattagcttattattattaatattatcattattttacataggctataaatgaatttcacatagctgtagaaaatcttttaaatctttaaaaataagttatgagatcaataacaatatatacttgtagaaaatataaatattagacatcaattttaagtatataaaagcaaattaaaaaataagttcaatcttacatttcaatcacatagttcagtcgtagggttagtattttcaatgaaaaaaagtagtttttagaaatagaaagatttccaatgaactccaaaatgtcatcctatactaaaaataatcactaccctttttgcaatgaagacattttccttaaccaaatcctgcatttttgaacatctagtccaataaatctacatacacacaattcttaagataaatttggtcatttggatttctttctacttggttagaaatatgaagggaaaacacaacagaaatatgaatagaaaatactttctaaaaatgtaggaattcatcacatttatattagaacagagaatttgaactttgtgatatatcttgttcggcttgctgtataatctactagcttaattatcataacagccttagaacttaagccagtacacattagctttataaaaatgcaatgctcatctgctatatatataataaacagaaacattatgatttatacgtaattgtatctgagccattatatcccagacactttactaatattatagtcacaaggctgagttctccaagaccagtgtacaaagttatctgaactaattttcccccacatagtatctaaaaatatatattttaaattaactgtaggatggtatatgcatatcattaatcatatcacaatcattgtgtttggctgtggctcttttttaatgacttaaagtgggggctgagttcattatgctgttactattaataataaaaaataactgaagtacatatacgaaatcaaaaaagaaatacaataggaattggaaccatattcttgtcacagctgtgtcactaaccagctctgtactctggaagttttcagcctctctgggtttctatttattcatggataatacaaaatcatccttaagatcaggatagatctactctctacaggttttgccattgtaaaatatgtcacaatggctctaaatcataaccctaaatttaggaattacttaattattcacagtgaacttctcttattccaactctttttatttgtattgttatacaagagaaaggcaagacaaaaacaacaaaaaagacctatttaagagactgcagtatatttttacctttactgtcatttgttaagcacctactatatatactttaccttcggcagtaaggatccccacacctattaaaagataattacatccatgtctttttcttatttacctaataattattttagcttccctagaaattggcacaggtttttctctcagtcacatgttaataattccagaacttaagtcatctgcacccaaaaaactcatacaaaatctgtcaagttgttttacatttataaatctggcaaacattagtgacaatctcactttgaaaaacagcacccacaatcaacgaatgtgttttgactgtggaaggtaggcagaacccaaggacataacacagagggaaaaaaacaaaagcaaataaaagccaatcaacatgaaatggtaccctgaacagagcagagagttctatgcggttgggcatggaggactggttagagatttttgacaggagtccatcttagataaatatcagagactaagttaattcatcttcttagtgattttatcacatccttccacaataataccacatgaagctcatctacacttaccattttgccaaaatgccagttaaggtatttctaactgcactggcaaatgtgggagattaaaacaagatgacagatttaatacttcaaattgtatcttgacatatagtaagtccactactttaaaaagtgttatgagaaagagtgccttggataacactgatcagcaatgattgaatgttaacttcagataattataataataaaaaattcactagagacctgatagaagaacctaagacacaacctcaaggcaataatataaggatgaaaaatacgagtacgcaatctcatagcaaatatgtacatgcacacatttttactattttagttatattggaacttgagaatttcacagcagtctactaaaatcacagatcaataggataaaagtagataagaagaatgtgcaatttataaatacggtttattaccatggttacaaactttcagaacaggcctctgagacattggactgagactctgccgaacatctgttaaaaaaaaaaataaaataaacttaatatagaggtctgggcatctcaagaaggaaaacagtattagacatacttttttccaaggttatgtatttctggcagcaaagtaatgcttcaatatcctgaaatacttgaagcagtaatgttatgacttttacttcccatttaattatgctactgtaaactccactgggataaggtacatatggttctttagatgagacttgtcacactaattaggattttctaggttcagtgcattgatttgttaatgtgctactgacatcggccaactggaatgcatatctctctgacatttgtctgtgcaagggattaagcaaacttatgaaacttctgaacagttgttgcccacggcactgcattcttgacacacaacttcaaaagaatgagaaaaacaggattctttctctgtgatagctccctagaaagtaacatgaaacaagtatagggttcaccttttggcatcggtgtcctttttcttctgtcgcggaaggcagccccggactgcaaggcctccagcagattatccatcactcctgtctcatcaccctctgtgaaaagagatgcagggaattccatcagccctcagggttaccatagcaatgtcaaagcatatacaaaaactggtgatggtgatggtagggagaaaaaagatcagatgccaggactaagctagcaatttcaaaataggacaggactttaactctctcattaaatcaactatcttttaatgaaaactgcctcattagtgcctatgttactgtgcactaaagggaccgagttccacggattcacttcagagcactgcttttatagtccaacagcacaattaccttaaatggaatgtggttctagtcatgtttgagtcttgagttataaatcacatttcctttgtagagatgagctattttcaaggcatcatcttctattctaaagtcaaccaggtatgggagagagtagtttttgttttttgttttttgttttttttgagacagaatctcgctctgtcgcccaggctggagtgcagtggtgagatctctactcactgcaagccctgccttccaggtttacgccatcctcctgcctcagcctcccgggtagctgggactacaggcgcctgccaccacgcccggctaattttttgtatttttagtagagatgggctttcaccatattagccagaacggtctccatctcctgacctcatgatctgcccgcctcagactaccaaagtgttgggattacaggcgtgagccactgcacacggcccgggagagtgtttttgttgttactgagattctgctgtctaaacttagcagacaaattatatttccatgctaacttttaaatataacagattatatttccatgcttccaacaattgatttttcatatcagaagataatcatcccctgacttgaggtgacacagaacaatcactacaaaattttacagaacgtatagtttatcttctataatgagaaataaatcaaaagaggctctctgaaatcaaaaggactgcactccattaagattactttaaattgatatcctgtatataattaaggaaatacgtggatatagagccaattatctctacaaagaacagattatgcctgtaatacttataagtatttatagttatcaatgttaaatattgttcaaagagaacaggagaaaaagcttcaaaggaactactggcccaaaccaaattcaagaaaaccgtaaggactttttgcccgtccagacaaggtaacttgcaggcattctttatgaaattgtatggctggtatactgctacatttaaaataatggaaagctattttccttcgaacttttattttttcctttttgatacacaatccctttacagagataagatgaaaagtgaatgcagtagaatacaaataacatactcatttacagtttataaacagatatataaatataaatatgtatcagccccttttccatctgctgctatttcatatttttagaagagtactaaaccttgtaggtgttatcaaaaaaggtgggtgagaaatagaatatttggaagttgtgaatttacaataaatgtaattctaagtgatttgatggctattttaactaaaatacattaaatatttcagacaaatagctatttgaaaatttattttcaaattcaactatatttttccttaaaaaactgcaggtaatgtcaaatatttaagatagtaaaagaaaaagaaaacatttcaaaatctaaaattacaattttaaatctttttcaagcagtcatgagattgaaaaaaaatcctagtactgaaatcaaatagaaacaaataaacatgttttcatattgatagattataaaggagggggaaaaaagaatccaagtaacttttgaatactttaatggcataaagtttaagggaaaaaaactataaagaaaatgtgaactttcttcttagtaaatttattgttggtagtggtattgatgtagtgattctcagactattgtgtgtgtataaaagctggagcagatgtgtaaatgtgccgatgtgctcactgtgggaaagaaaatggaaatatggaattggagaaaaagaaaaagaaccaagaagggttggattggatgtataggtattaatgtaagctcaaggcttaacaaaacaaaacaaacaaacaaacaaacaaaaaaacccttttcctataacactatagtagcatcaatgagcatttggatcttggtttctagctaccgttactagtcctaaaatcttcgtttctaatgacctctctcgccctcagatcttggtttctacataccattactccctaaaaggaatgacaatgcttacagaaatggctgattctagaactgaggccaagaaagtgtgaaatgagtcagaaacatattgttgtgccagaaaataagaaagtgctcaaaaatagatagtgatatgttgaaaagacaaagaagccagattgaaacattgccttggccaaatttaggacaactgagtatcaaataaataatcatgggaatgggattattgcacactgaggaaaaaagaatcatgcatccatagtgatactaaaaaatacatagtaataaaaatgtaggaaggagagttcctctttaaagaacagtgtcaactaatagatgtcaaagatatgagggaactacaaaattcaccacattacaattcacatagtaagaaatgattcaggcaggagtcatcaacggttgcaaaaactattgtgcataagggatgtagaggaacaggatatagagaaatctggtagataccaccttatccaaataatcaaatttgacattaccaacaatgtggaatatgctgatatcaattgcctcctgaagtgatgcacaacttaacctgtgtagcacttcgcacaaaaatatttaacttgaatctgaatgcaaggcaacaatcatagaagtccaaagtaagggacattctgtgacacaactggcctaggatctaaaaatgtatcaatatcatgaaagataaagagaggaagaaatagagaaagagagaagaaaaggctagagaactgttctagattaaaagagactaaagaggaacgacaatgaagtatagaggagtccctgattaacccctgaattgaaagaagttatatatgacgttattgggataactggagaaatttgaatatggactgggtatcagataattacattgtaccaatgttaagttatcagagtgtgataactgtattatggttcactagaataatctcattgttcttaggcaataaatgctgacagttttaggctcacaaaacaacttacacagtctcatgtttattacttcatgcctttgaacatgctattatatctacacagaacatctgtctcactttcttcaccaagctagctcttacccttccttcaaaacggagaactgagaatcctttcctgacccatgtggcataaactaggtgcccctctgtgtcccagtggtctgtaatacatataccaataaattctttacaatgttatattgtttatgtgactctttctaccactaaaccacgagcccactgagggcagggattatagatttcatttatcttcaacacctggcaaaatgcgactattatatagagagtgttcaataaatatatgctggctaaattagctaaatatatgttgactaaattagctaaatatatgttgactaaattagctaagatggtcagctggaagggttgattatgcatgagaataaagctcatagatggacaggggtccagggaagagatgggaatacattcccgccaccattctaaacaacacagctttctttcttccttttcccttgtctcatacatctatttagttgtcaaatactatagactgaaactccccattatctcctgaactaatctgctgttccttttctaactacactttatgttggtattacagaactgaattattttttatctggaatactgcatgagttgcctagtcacattgcttccagtttctccctaattctgcccatgcattactgataagtaagtcctacagcagaaatgatcttcagttcccccggtcacaaagtttcaatatatctcagttcttacaatataaagttccaactctttttttcatttttatttttaattttcttttttttgctcaaatggattttgacagataaagtccaaactcttattcctaccccaacaatgatttcaattgtatttccaattgtatctcttacttccaaccatcccaacctgttctttagctaaaggcaactgcctgtgattctctacaaacattctttctctcgtccatcactgtccacctggaacctctacccctgctctcatcctccagagcagatggctatttttggccttcactctcacatgcataatgggaagaatacaataatgaagtaaaacaacttgcattctagtctgagctttcaactaactacctgtgagacactagactattatatacataatcattcctgacatatgcaatacagacaatacctgtctagggttaatgagggaatcaaatgagataatacaaatgaaagcacttgataaattgctaagtgatatacaaatatagggaaagaaattcacagataaaatccatggtaaattacaggacatgtatgaaatgcctgcttattattaaatgtttcaagcactgttttagatatgttacaaatgaaggaagtctttttctttttttttttttgagatggagtcttgctctgtcgcccagactggagtgcagtggcatgatctcagctcacagcaacctctgcctcccgggtccaagcgattctcctgtctcagcctcccaagtagctgggattacaggcgtgccccaccatgcccacctaatttttgcatttttactagagacagggtttcaccatgttggccaggctggtctcgaactcctgacctcaggttatctgccagcctaggcttcccaaagtgctgggattacaggcatgagagtcaccgcgcacggccgagggaagtcttttatagtgtattctattacgctcttcattaggtataacatcatttctaagaaaaactctgacttgaagtacaaatagactcttgaaataaaccaaagtgtaagatggggacatataaagaagatgttcttccaaatgttaaaaatgcatttagaacattcaaccaacacatgttcacctggcatatggtacggtgtgccaggatgttactaggcactaaagatacctaagacccatgcatatggtactgtgtgccaggatgttactaggcaccaagatacctaagacccatgcatatggtactgtgtgccaggatgttactaggcaccaagatacctaggccccaaaggtaaacacaaaagcatttctgctctcacaagcagaaaagtgtatatatgagttactggagatgtacagcttcctagtgaatgatgactcgaagaataagcaggagttactcatgttagggactgtagagggaatagcattcttggcaaaaggaataacaggtacgaaggcaaaaagtatgaataaaaacaaaaaatgaggtgtaataagatgtttagatgatttatatttacagtattctaacatagaccagagaagttaaaattagtcagtttttcttagagtagaattcaatttctccagctataatttatattaaaaatatttatagtttctcccctgctgtgaaaactcttaaataactagactaactgcaaaagtcaaagatttcctatatgtgaaaaacatatcatcttaatttgtaaatggtattttaaaaaattgcactgtgtcaaaggaaatggagaagggagagttaaggacatttctaaagtggaatcaataggtcttaggaaccgaaagaaggcggaactgctaaggacatgtctgagatctctgcggcccattgctggagaaaagaaaatatgaaatttaaatattattgattttgatggggaacaaagattggaaaatataatgagtttccttttggacatgttaatggaaggtgctagcagggacctccagtaacttctggaagacagctggaaattcgggcctcaaattcagacaaaaatgtgggtaatatttttggaagtcatttccatattgtaaaaaatactcattcagcactctggaaaagtatatgcctgaatcagaagaggtggcatcttggaaaccacctaagtttaaaggacaggagaaaaaagataagtcagtgatccagtaggaactctctttccttattccattttcttcagccacggtacaacctgaaattttaaataactaagcatacaaagaagatcctaaaaggttctagaatgctgcaagcaagtaaacaaatgaaaacaggtcaaatatgtaggaaggaaataagactaggactggatttctcagtggcaacactgaattccaaaagataggcaagaaatggtttccaaattctgaagcgaaattatttccagtgaagaaatgattatgttgctaatcagacaaggatagaaaatggacatttttcaaacatgcaagtgtctatacatgccatcttagaaagagactgcaagatgtgcttttgcaaaaccaaaacaagaggggtagaatagtaagaaagaggaaaacatggcatccagaaaaggagaagggacaagagagcaaagtggcaaaaggaattcccaggatgtcccagtctcagagcagccagtttagatcacatggatcacatgggaggaaactgggcagtgggacagagtagtggccacagaaccggtagcaaatctattgtgtcggaccatttgcaaaatgattgctgattatttcccagatccattgaagactttggataatacagtaacaggtatgtatgtacaaatactaaacaaactttttgagaagtctctattaatctagaaacaacaagattgtcccataggaaatgctgtagtctgaatgttagacttgatctccaatgtaatggtattaaaaggtagggtctttatgaggtgattaggtcaggagggcagaaatctcatgaatgggattagtggccttataaaagaggttcaaggaagctgttagtcccttccaccacatgaggacacagcagcaagacaccatatatggagcagacagtgaaccatcaccaggcataaaatttgctggcatcatgatcttgtatttcccagccttcagaactgcaagaaataaatttctgttgtttataaattacccagtctaaggtgtttttgttatagcagcaggaaaaaaccaggacagaaacaaggaatactgaaatttggggtaaagaaaaaaaaacttaaaaattaaaagaagaaaaataaagaaaacaaagtatatttacatagtgccaatattataaacactggccattctgttggccatcaactgtgatataattataatgaaagacaatggggtaaaggaagaggggtaatccacacaaggtggattagtggtgagagggcattagggaactaaatcaggaactcagtaatgtctaaaataaaaaattgatatgcaacagtctatgctattatctagaaataaggaacacataaatatcagaagaaatatctaagaattaaaagtgattgcctctgggaagtgggaggaggttgagaggagtgagggagaagatattttatcatgctatgagcctattatatttaatttaggaatttgtagacattgataaatacaagatagttaaaaattttattgaaagagaaagaagatggctgaggaagagaatttgaaggaagaggttgattcttgacctaaagatgcttacctctgagaaggggaggaagacaggtaaaaatcgtaaaacacaacaggttgaatattatgacagagatattcagaatgtggtacagggtggtgggcatgtagtatggggcagagggagaaggaacagcagttacagaaggctcagaatatctgagacttaaagaaccgatttaagagtgccagagctgtcaaaagagacaagacccagctaaagctgtcaggaaagctgtacaaggcagggattcttgaagaatgtgcagtggatatgagtaggaagagataacaggggtaacgctgcgaggtgaaggtgaagagagagccggggccaactcaccaagggctgaatataccatgctatggagtttagactttaaaggagccatgaagtcattttaagctaggaagtaacatggtcaaatttctactttagaaagaatattttgagaagagaaaagactaaaggcaaaaaacaaacaaacaaaaaacaaacccaagaggcatgtttaatgatttaaatctagacaaaatgtgatttcagggcccaagtaagttacagaagtggtgaaaatagaaaaaagaaaggaggagacatagagaaatcttggtatccgtggttgtgaatattataaagaaatagttaaggctgatttccaggcatttggctcagccaattgtatatatattgatatcatttgccaagtacagaaccgtctttgtttgatgatagaatgagttggatctagacaggagctcaattttggatatgttaagttgaaatgttcatgagatatacaaatacaaagtgattcaaggcttctagagggctgatagagtcacaggtttaaaacttgggaaagaggaattggttacactaatacattcaacttagaagcataggtcgtacctgaaactatggaaaagagtacaagcatagtaaagtggtagagaacacaagttctgaattcatccatttagattcaaaccaatggctccccaactaacaatcagtgttattgggcatattacttagtctctaaaaccctcatttattccccctaaacgttgaaagggcaagaagaacagcacctatttcacaaaatattgagaggattaaaacagataaatcacgtacaatgctcagtagggtgcctggctcatattaagagcttactaacagtgaatctttgttattttgcttattgatattatggtagagcttgagctctcttagggagacattgtgtagtgacaagaaaagagagctgagggtaatgcacaaggcaaactaataggaaaaggtgcttttaagaggaaatgactattatcaacctgtgaccattttccattgtgtttactttgtgtgtgcttttatagctccttcttttactttccactgtctcctgacatactttcctaaagtcaaacaactatatattactattatttatttatttatttagaggcgaagtcttgctctgtcgcccaggctggagtgcagtggcgcgatctcggctcactacaaactccgcctcccaggttcaagtgattctcctgtctcaacctcctgagtagctgggactacaggtgcacgccaccacaccagctaattttttgtatttttagtagagacagggtttcaccatattagctaggatggtctcaatctcctgacctcgtgatccacccgctttggcctcccaaagtgctgggattacaggtgtgagccactatgcccagcctatattattattattttttgaagacagctctgtcacccaggctggagtgaagtggtgtaatctcagctcatggcaacctctgcctcccaggttcaagtgattctcatgcttcagccttcagagtagctgggattataggcatgtgccacaatgcctgactaattttttgtatttttagtagagatggggtttcaccacgttgcccaggctggtcttgaactcctgagctcaggcaatctgcctgcttcggcctcccaaagtgttgggattacaggtgtgagccaccacgcccagtgacattttctaatatttcagtagtagtaagtgacgtgaagattacaatctggaatttggaatgggactagggaaggaaagcacagtttccccaaaggttgaaagtgtgcagttgatatacaaaattcataggcttatagtttaacccaattctagaagaaaaaccacacacgcgcgcacacacacacacacacacagttgccctaacataattacatgaattattcctctatgattctggttatagagatttttgggaaaaagattatacagcttctcttggtaacccagttcagtctttaactagctagaacaaagctcaaaatgctacttaaaccagacagcaaaaagacaggaataacttcaaacaaagtctttgaacttgtcttaatccagatgtgaaactgaaaatttatttgagtcaagggagttagaaagccgattttcattgggatttaactgataaaatgataatcagaacagttctctttcatactgtaattaagtgactggctcaaccacaagaagtggaattttatggggaaaaaactccaataggttaatatttctgtttttttctcccttattcgtcatgatttgtacaaatttcattaaatatatttctgttacaagttaggagaaaaaattagaatattttacaagaaaggaagttttatttattttttccttaaaatagagcacccaagagcaaagttaaagagtgaaactcctggacttgaatcttgcttcttactcttatcagctgtgtgctccttaaagaccacccctgtctccttgtgcctcctcatacctataagatgaggataataatagtatttatcctcaaagactattgtgaagattaagcaaggtataaagagcttagcacagtgccccccatatgtaaggcttaaaaaatattagctattcatatttttaatattttgatgactattcttgttcactaatatagcaaatattgctgattagtcaatgcaacacattcattctctaccttctccttccttccacagaggctaggaaagctaaaatttctctctgtggctcccctgcagctaagctagaagtggccgtgtgatgcatttctgtctaataaggcatatatgtacataaagtatggtatttctagacataaaagatgtatatgttgataaccactcttcctcttcctatcttaaatatggcctggaattacggcagctatgactgctatcatatgttaccacctccttcttcctatcttgaataggcctggatctgtagcatccatcttatacttaggagtacagaccacaaggtcattcttttagttgctctggataaaacatacggcttgctggagcccaggaggcagaggttgcagtgagctgagatcacgcctcagcactatagcctgggtgacatagcaagaccctgtctcaaaaaaatcccatgaccaacaacaaaaaataaggctacattttcaaagtttaagtgaaaaatattttgcagctacattagaatgtgtaaaccataattagcatacaatttattacattgtatccaaatttgaatctaaataatttcatgtcttacactaaataggattatagagatgatatttatgaaataaaggattattattctacaaactctccagcttaaaaaaagaaacctattcttggatgtcatgaataaactatgattgaattttaactatatacacaaccaggaaaaatggtaatataaatatactataacaaattgtatcatattgttattaattcttaattttcacatttcttatgatttaggttctgttgtaagaaaataattccggataaaaaagctatttatctgctcacttaattgtctactcaaataaaaaagttacaatcatttttggaatataaacatattaaggcacaagatgtaagagtaaccatataatggatgaatttgtcattacaaaaataaggagatatatcacatttaaaaagaaaaaaaacttcagtacataagacagcatttcctaaagtgtgcaccacagaacactagtcctataagaagctctgtgtgtatgtgtttagggagagggggtagagaaggtggctctgtggtcaaataagtttggataataatgagcaacagaggctgggtgttgtggcttacgcctgtaatcccagcaacttgggagactgaggcaggaggatcacttgaacccaagagttcaagactagcctgggcaacatagtgagaccttgtctcttaaaaaaaaaatagccagtatggtggtgcatgcctgtagtcccagctactcaaggggtgacgtggggggatcactcgagcccaggaagttgaggctgcagtgacccgtagctgagccactgcactgcagcctgggtgacaaagtgagaccttgtctcaataacaataataataatgtgtaacatgtactacacttggtgattcatatcaaatacacatgacaagtcaattcatgataaaggtggcatttcaaatcagtagaagattaaaaaaatgtgttcaataactactgtggtagcattagcctatttggatctcaccttgttatttataccaaaataaattccaagtggatcaaacatttcaacattaaaagattaaagtgtaaaactatagcagagaatatggaaaagtatattttcagtagttctggaatgggaagatattcctaagaaaatccaaaagtaatataaatatctaaaaatcaaataggacaggtacagtggctcatgcctgtaccctcaggactttgtgaggccaaggagagagaatcacttgagcctaggaatttgaaaccagcctagacaacatagtgagactttgtttctattaaaaataataaaaaatcaaataataacaaactgtacacataaacaatgaaaggataagctggaaaaaatatttgaaacattggcattccctcggtctgattttcttaaaataaagaatgcttgtaactcagtaagaaacaccaagaaatgggcaattgctattcagggaacccatcttctatgatctgaatctttgtgttcccccccaaccccaaatttatatgttgaaatcctaattccaaggtgatgatattaggagaaagggctttgggaggtgatgagatcataagggcagagcctttgttaatgagattagtgcttttataaaagggattctagagagctgcctttgtcccttccacaatgtgaggacacagctagaaggttacaggccctcagtgaacactgaatctgctggcatcttgattttggattttccagcctccataactgtgataaataaacttctgttcttcataagctactcagtttatgatattttttatagcagactgaatggactaagacaccataacaaaaataaataaaccatgctttagatgtgatataatcctcaacctcattcataattaaagatattctaaatacatcaatgagagatcattttcatctaacagcatagcaacaatgaaaaattatgataaatcagtattggtgaagggttggggaagaggtcacttcacacatttgttgctgaaaaatataaaactaatgcaatcacttcggaatataatttagtaatttttattagaaataaaattgtggccatctgtggtggctcatgcctataatcctagcactttggaaggccaacgtgggtgaatcgcttgaggccaggagtttcagactagcctgggcaacacagtgagacctctcctctaaaaaatagcttttttaaaaagaaaaaagattgcacatatcacataataatttttctctgagaaaattattctacatgtataacttacatgtgtggaaaaacatgtaaaagggtgtctgttatattgttgttcattgtaacaggagactagaaacaaactaaatgtccatctacaagagattgactaaataaactatgacatccatataccagaatattttgtactgtcaaaaaatgaggcatatttaaattattgatatggaccatctccaaaatatagtaagtgaaataaaccaagtccttattttatcaatgaggacatcgaatgaagacctttctatgaccacttatggctattaactacagagccagcaatgggttttacgacttccagcagcttagcaattattccaccacatggtgctgaaaaaaggaactacttaatcatttttccagtggtaaatgattgttaaaatgtcttgcatgtaagtattcaagtaacccactctgatgagcttgttcactctgacctattctaaaattactaaagaaagcaaaatttagaaactggcattgactccctggcaaaaagaatgctaccacagtcgaccttgtgtgttatgtagggtctagggtgctgaacagatgccttcagttgcaaaagcacagaatgtcggcgggtgggggggaatgtatctatttaaatacatatgtagatgtgaagtgataatgacatttaacaaaatgtgactatcacacagagcgaacacccacgatcctttaatcacagagtaacccagggaggaaaaggttaattacatggcacagcacctccacttctgggtagaagtttcacttgtcacccacaagagcttcactttattctgagtgaagtttaacaagcttaagcttgacaaatgcttacttcgcattgaaaatatattaggatttgttttagatttgttttagtattttattagtgaagaattgacttttcaatggcttttttccttatgaagtttttgaataaagaatgaaatggtttcagataatgaaaatgcttaattcaataagaattaaaaaaagaaggggaaggagctagagaataatatcggtaatttcacaggaattttctttcaggagaagccaggataaatggacttgaggccacgaggagccagtgagtggtgcctggaacaccgtatgatgcccagaggagcccagcagtcatgctctgacagcagcatatggtgcgcactggaagaaggggaaaataaggtcaggaaggcagactgggagcttggattcgaggctgaagaactgccatcaaatgtttttgaaaggtgtgaaataatcaaaactgtactccatgatgattaaagctggcatagtgtgaaggtgtcaagcctgggtgactgggaaaatggtggtatcattaacccaaaatgagaacatgaaaatcaggttttatgtggaacacgacaagttaggttttagatgaattgattttgaggtactggcagaatattctgttttgttcaggaagtagttggaaatataaaactataaagtctattgtttaattcaattctacaaagatacactaaggactacgtgtcaggcactgaactagccccagcccttgttcccatgggacttaaatgtaagagcaagttcaacacataattaatgactacctgtatgacgaatgttacacaaaataaatcagggtgctatgaaattgcttaatactgaggcaatagaggtgaagagctatagctatggttgcctagtgatgattccaggggttattctttgatacctggatttttacttaaatttctgaagatatgttttatttgtaccttaaacacagaaccatatagatatcacagtaaactgtggaaacctgtgtattctcattttgagctttaagggttaaagcccatctcactgctgccaaccttgcacaaagtaatttttaccaggctcaagttctttgttcatttctaacataaactttgtgttcaaagtactataagtattcattacctttgtttcattttaaaggagaaatgcagatttattctgcccaaatataatgtccttccttattccttccacagtgagatgtagcatcccattagtattaaacacagaggaaattttaaaatcctattcagaataacagcaacattgttttgaaaaggaggaagtcagcaaggagaataaggcaaatctgaatgagtgaaaattggtgaagaaaaagaattgacatatgctttcagaagaaagcaagtatgagaaaaatgaaagaggagacaactgaactttcaatgaactcattaacaattgtaaaaaaactggaggcaaaaatgtgctacagtctcaagagaacaatgaaagactccctccccccgctccacaactataaaaagctgacaaaatgaatacacgagccccacagtaaaagctgatattaggtaactttgagaacaactttattttatttttatttatttatttttttgaaagagatgagtctgtctctgttgccctaggctggagagtgcagtggcacaatcatagctcgctataataatctcaaactcctgggctcaaaggatcctcctgctaaagcctcctgagtacctgagactataccatgcccaagtaattaaaaaaaattttgttttataaagacaggatctcactatattgctcaggatggtctcaaactcctggcctcatgcaatcctcccacctcagcctaccaaagtgttgggattacgggtgtgagccatcattcctggtcaagaacagttttatttaggaaacaagagatacataaaataaagaataaaaaatttaaatatgaattaagacacactaggaactatcactttgattgaatgcctatgtgctagagtctgtatggaacattttacctagattttctaatttaattctcactcccctctttcaaagtagctattatctaatccattttaaagttagggaacttggagctcaaaaaggtaaagtaaggtgcccaaagccctgccatagggtggtagcagaggggagatttgatatctttctgattctaaagctcattctttccactatagacttttattgagagaggtgttacatgaaaattgataactattcagatccttaggtttgctgacttatatttaaaggtgttttaggaaatgctttaaggcacaaagaggtagtagctttcagagcaggaaacaggagcaggcaagcacaagctcgtttccccaaattcgacgggagctttctcccagaatctgacaataagagagatgcaggtcattcacagatgctccttcctcagagagaaagaccagaaacactcctcctcctgagaccaggagtatctgaaaatattagaattacttcaatctgccatggcctcctgactcctcctttcaacctagccactggggattgctgtagttgggctaaaactttgaaggcagctaaaccaccatcaccatcattcttagacaacagtgtccttctgatctttatttcctccagcattattagcatgaacaatctctctactacctcaatttcttcaccatacactcctttcacctcgttctcttaattgaaaatgggctctacttggaaactggacagatgatctctgctcaccccttctggtagatgttgcttgttcccctcctatctcacgtgcttaaagtctgcagggcacaggtggaggacatgggaatgtctgctttctccttgatcaaagctgctatgtcaggctgtcacttttttttcctcatgtaaaaagcacccgcctttgagacacatgtcattcagttacactgctgccatccctctgggtcactgtcatctaatcacgcacaagtctaccctctcattcagaataaactgtcaattgagtcagtcttcctcatcaggccaggctctgccatcatcttgtgagaattcagtttaatgttaatatctaatccaacaccaggtcctaagagttccttgacctcctcctctccagggagcaatcccttctacttcccatcaccgacttccttggccataatcgaaatcttgtcactacccagagctgttttacttccaataacttgaattcatacaaccattttctgacccatgtccttttcctctctctcttttcctgtcatctacccatgaaaatctccaatgccctggcaccactgttttcatatccttgactatctagtttagactctgtggtgcatcactttgaccatggttcacacgctggtatcttacttccctccttcattctcctactttttcagactcccactaaaatgtaaataagccccaaactccatcttcttggcattactccagatgctgagtagtgccggtaagaaacaataccacaggatctgaactagtacatatgtgcaactgctacctcaattggattcttaatgctattcagcactcctctgtgtttcatcaggaggctctcccactccctgagagggtttacatgcttacacacttcactcaagcctcccaaccaaccatggcccttcctctgcaaaggccttccttttagatagaaaacaggaaccacttgatgaaagcttccttaacttcccaccatcaaacctacaaatgtatctgcacttaggcccaacatttcctcctttcaatctatcacaatggcagagcatgtggatttccaagacaatttcctctacctgtgctagtatcttgttgttctccacccctcctgccgccctcagaagtttactccattgattgtcattctcttccaattgccctcctttctcattcctcccagtctgcatttaaacaaattaaaacacctgctttgtcctcccctttgacttctaaatcccctgtagttactaccctttcttactcatatctcagtctcatctcccatattcattcattaactctttacgctattctttgagctaaagtcaatgggatggctgttagttcattacatgattctttagcagtatttgattgtgttgactacccattcctttttgaaatggtctcttccttgggcttcatgataccagactttcttggtcttcctactactttcatgtgactcccttgtcaaggtcctcttctgggatcttcttactctgctcattcttacaccattccttgaattttccattggtgttttattcattccatggcttcatttactgaaaactcccaagtttttatcaccagcaacaagcgctattcctgagttccaactagggtgaccaaccatcctgacttgcaagactaaggggtttcctggaacacaggactttcagtgataaaactgggagaattaggcaatctgggatgtgttggtcatactagccccttcctactcactagacatggtaacctggatgtcctagagatacctcaaatataatacagactgttcccaacttacaattttttgactttacaatcaagcaaagcaatacacattcaacagaaactgtacttgactacccatacaaccattgtctgtattcaataaattacatgagatattcaatacttgattacaaaataggttctgtgttatatgattttgcccagctgtaggctactataagtgttctggaatgttttaggtaggctaggctaagctatgatgtttggtaggtttaggtatattaaatgcagctttgacttaaaatatttccaaattatgatgggtttatctggacataaccccatcaaaagttgaggtgcatctgtatatacaaacttgaattaccattttccccaaacctctacctcttattgtgtcccttatctcagtgaatggcaccacctactcatgtcaaaacactatgagtcctttttaacaactgttgaaggtaaatataatagaaggatttctgtatccctaagcactgagtttccagttacatttcctattaggggaatattcaataggattcttatatagcctgtcagcaatttcaaatcttctttagtgaaaaaaaaaaaattaaaaaatgtatcattcatttgaaaagttacagatctgttggatagtgccagtggtgcaagatttttttcttcaatgccacatccttctactgtccaagttctgatgcgaattttgatcactatctaatccactataaatatcatttatttatttatttttatcgaggcagggtctcattgtgtggcccagactggtctcaaactcctggcctcaagagatcctcccacctcagcctcccaaagtgctgggattacaggaaccagctaccatgcccagcctagtataaatattcttctttaaacattttggaatatttctaacatgctgtttaggaatgattaattttccttcccaataagctgaaagaaagacatgttcctcaagcaatgaaactctggaaaacaatttgtattaacttgtgaatgcctcagtctgcaagacatagtacatgctttgtaggtcattaggaaacaaaatggttgtctttcatagttcattctgtaaatggcctgtgggccgcagttagctccacacatctcctcactctgtgtgggctccatcaaatattgcctttaaatttgcctggacaactgcacaaaggagaatgaacgaaagcttcagattaagaatgtacgagaagcacaagacgcaagactcttcaggccaaaggaagtaagacaaaaaagtgacttcatggtgctctgggttattatatttatatttcttcatcttcattcagcatgagacagtagataggctgataatataatgaaaaattaagactaaatttcaggaagaactatctgaaaagaaatcattattactatagggcctggccaccaaggaaaatggcatcctttcccttctcttgaatttaaggagatgcttctgtcccagggaatttaggtatatcattctctctctctttttttttttttttttgagatggagtctcgctctcccgcccaggctggagtgcagtggcgtgatctcagctcactgcgagctccgcctccgggttcacaccattctcctgcctcagcctcctgagtagctgggactacaggtggccgccaccattccaggctatttttttttatttttaatagacacagggtttcactgtgcgtgctaagatggtctcgatctcctgacctcgtgatccacctgcctcagcctcccaaagtgctgggattacaggcgtgaaacactgcgcctggccaggtatgtcattcttgaactgggtggcttgctatggtttcacaacttaaagtttgttactagacaaacagttacagacatattctccattgctcaatgtatttttctaagctcatgcttaccatttccacccgcttgccagccatcttgtgaccacatttgtacatattagtgctttcatcagggggtaagtgcatcaataagaggagaagttgaaattagattagttaatttgctacttcattaacagctgtggtaaaaagtccaaggagaaaaaagattgaaactagctaaaatgaggggtttgtattgtaagtgaatctaaattatctatgtcccctattcctgcggataactgagagtcagctgtgcacacatctgtgggtgtttataaacatttaccatctgtgagaagcttatggggcgtaaatggtgggctaattagtgaaatgctagtcatttctaatgacagttgttatggataaagattttatccaggttaaattgatctcagaacctcgatcacgggaggccactctaccttttatgacaagactaagtagttacactatgctgaacatgtcacacattaaggatgcaccataactagattagactgctagtttatgcatgttaatgagctctgttcttaatagactgaagtgtggattgagtatttgtcagggaaaatgagaagttgtcagtctgttgaaaggtcaaccatttctatagtaagacattttcatttctgttctacaaatatattaagtaccttccattcagaaaattaagagcatagacagaaaactatgagattcataaatgaaaagagttgtccatatacatacacacatatgtgcatacagatatatttccctaacttcaccatatcagtaactttttctaaacatatcttttactgatccatattgtgggcaaacattctaaacaggtaattttaaactaaattcatcctataaccaaaggggggaaaaaaaccatactgtataagaagagagtcatatttactgtgtaataaaaagtatcttaaagtagagattatgttgtaaaagaggacagtgtcatagaacaagtgagtggaagagtaggcaaaacttcattccttgggttctaataaagtttgttattaatttacagaatacaaatggaattttccaaattagaaggaatcttattgtgtagataaggagaattatggtctgaagctaactggcctgctattacttagctactggtggagcagggactggaatactgataacccaactcctaaaccttagcaccaaacatttcatgacaccactattaacagagaatagcaatattgtatataatgtcaatagttttagtaaatgaaaaaaaaacaccctatgtaaaatgtcactccttcccacactttctatccccccatccctactttattttgttctccttataagttgtggacttctaatgctgtttatttatcttaaatgttgtctgtctcctgccagaatatatgcccatgagggccgggacactcgcttgttttattttctgctgtacccctagtgcctaggatagtatcatgacataatatgcgataaataaatatttgctgaaagaaagttttgatagaaatactttttttcaccatcacactaataattctgctaatgaaggaagtatttcaatgcccatttttataatttcttttgtcagaaatttaatggtcacaaaagcaaatcacacaggagccttgggaatgtctttcagaatgttagataaggtgtaattagtacctaatgaaaaaacaataaccaaatactgactacaacaatatcacctgccagcaaaataaacgaatgcagacttcaataatgagaatcctagagccttggaactgaatgtttgggctagttttagatgaagaggaaggagtgggactgacctgttttccttcaaggggataatgggacacattctctccattgccctacctgaaccccatgcctcagattctccaggaaagggccacctccagcttatcctcatgagctaaacatggtttattttcagaggttctcggttaatctagctacaaaaacttgcaaagttgtctttattaacaaatttgtttttattttcctctatgaaagaagttaatagttactgtgcagatgttgtgtttcttaccctatgccaggcccattcaggtaaaaaacactcccaagattaaaaagcctttaaattggagatgtaaaatctatgtgttctaaagctggtaggagcagcatcacctacctgttcatgaagtattctccctgtctccccacacccaatccactagaaagccccattgattctgcctctaaactgcctttcaaatccatcctgtcttctcttttcagtgcatcctagttcaggtcttctacatttatctcttgcaaaattgcaagtgtcctaattagtctcattcctcctagtcccaacaccctctgatccatctgcgtttttgctacagagccatttctctaaaagcaaatcatatcactgctctgtttaatgcccttgaaatgtgcctacaaaataaagcaaaaaaaaaattcaaagcatagcatggtttcttgacttccaatttagcatcatttctgcccatagttctacccaaagatcaatcaggcctgctacattactggttagtccatatataaatgtcacacctctgtatctgaatttacttagcccattggatgcccaggcacagaaactctggcccttcatttcactgtgttcatttggtatccacctaattcaagattccacatttcaaaggaacaacaaaggtagtcttttccacatttactgctcagatgtcaatccatcctcctctctcccaccccaatgtgagagccaaaggatcattcttagtacaggaaccacccatgtagcagaaaatgcacaccacattcttaggctctgaacagaaaagatgcccccatctggtggaagagaaattggaagtgagattacatgcagtgcagtagccctgcgcattcatcccaggaggaagtggcgcatattgggtagactttcctaggaagttacagagagttgagtccaagagtggaggtgtcttgtgtccaacatgcagaattgttgagaatgggctaaggaaacaagattagggtacaagaaggctgcagaagcaccacaagaagctgagtgctgtggttgaagcacagtaatttcctatgcatcctgcctggggaagaaaaaaaaagttcactaagaaagagcacgagtgcaagagaagaatgtttccaagaatcattaacataaggaagccaaggagggaactaagagaaatccaattgttctatttggttaccattcaaaggcaaaccagtgatcacctttaccacaagcagacaggaggaatgatgccaaagcagggaggctgttatggacgtagatgccaactgaaccagaaagagggcatatgcacagaagggtggccgaagctggcttccttcatcgaaggaagaagggagataagaagagatcatggaagggaatttcaaacacaaataacaactctctactgaaattactggaaatatgcacacacacacacacacacacacacacacacacacacacacacacagaaggagaattgactacattgttaaccatcaggtaggctgatgactcagtcataaattaaactgcatttatagaaatagttatatctctgcatatctgaacttgctgtcctaactatgaaattccccgtttgttaccaaaagtataagagcacataaaacaaacttgacatatgtcatatcttgtcctaggattgtgccaatctattttatggggtctgcataaatagaacatgtacagttgaggagtttttgtcccacaaatgtgaattccataaatatttttaaagtgcttattaaacacctgctatggaaagaaattagaagcaacagctcactgtaaaagatatttttttgaacatggttaattttgattaaaggttttatttttgtaagatttattattgagaaataatggcatgtttgatctttatgaaaagcaaatttttcatagcaaaatcaaaatattaactgaagtatcatttaaaatgactatagtaaatgtttcatatcatgtccctcctttcttgtactttattaaagattaatattgagtatctaattaatgaaatgagataaacacttacttcaaaaagacttctttttgaagtttctaggaggaatacaccaaattgtcaaaacttctgtttcagaatcagctgacctcaaattggagcaggctaaaaacatgcacacaagtgcgtgtgtacacgtacacatgcatcctcccccatatagaaaccctcattactcattagttaagttgtaatatattcagatggaaaattttatctctaagcgttcctcagtttctaagaatggtaaacaccatgagatatattttccccttcttttcttacctttccctttttagaactgataaaagatgactgagttcatatcctacttatatcaaagtgcaatgctttaggaataggacagtatcaagcataaaatgggaattatctcatagggaagaggaagatgtgaaaaacaacactccttccgaagatttccccatcacatgagtgtagcaattctgaacaaagcttgacatcatttgggttcttctaatattttctgggcagagaagaacgtttctttaatttcccacaatgcctccaaatataacattaagacattttatgctcaatctcggcagatatcatgatttaggaaacagcatttcctcagactgcaatgctatttaccttaatgatagaatcaattagaatacagtataatccaaacgacatgtttcctcagaccaaattccttcagaatcccatggaacgggtctctgaaagtttgtctatgggtagtgggagcagaactagcatctttgctcaagtgtgaacggtatttccaacgatcataaacaatattttcatctaccaaagccaaaatcacagagtacaattaacagagtcacagcaaaatggtaaaataatctgttaaaatagttaatacatttattttttatctaataaaagtatcccatgcgttcaagaaataatgagtgactactatcaaaaggcactgtcctttttttgagagaagagcattagtgttccatatcaaaccataaaataaataataaaggataaaggttttaaaaaagtacttttattcacacgtgaatccagcagaaagtacaatctaattagccttgaaaacatccactgaaaatcagagatcataattgcaattcagcactaatagaatcattacttctgaaatatatctgaaatgcagcaaaaagactttttcttagttcttggcctttgaattaaaataatcttttgttccccaagcaaacaatcttcttgactttgtaacacttgaaggctactttgcagttaagttaaaaagaggaactgtcacacatttagaatcttcaaactaattgccacagaatcagtgttggaatgactttggagggaatctatccagtttcctaaagcagtgatcctttacacaacactcatgaaagctagtaatagaacctcagattcagcactaattttacaagagttcctgcctgaatagcactaatagtttaaaaataaacattcaaaggattctattgaactgaaattactgtcacttatacccattaatgataattattattggaagttctatgatggcaattcactctagtcaggcaatggtctccaagaattgcttgctctaaagacagtcagtcatctattttctgttactatgctagtctgtcatattcttcctgccttggggcattctagcctgtgttaaggctgccctcattgttaactctgttactatcatattgcttataattctcttgaaaaacattggatatctgaggaaggaagctatccaggaaacaatattttaaaatcctattacaaaataatgtctaatttcatctaaacactaatgcctatttataccatttacatgtaacatataaatattcaatttctttgcttaatttccccagtctgccctagggtatatttattcatcatcaaatgccaaatactactgagttgttttttttccccctctttgagataatcactttagactttgagcaaccttcacgaccaagttcaacaccaatgaatagatttccttcaactttaaggatttaatgtcagaatgacccaaaatacaaagaaaagagagaacctattaataaaaaaagaaaaacctggctccacctatgaccttttgacacactgatatttccatcttgaaagatatacaaacaatactatagaaatactggggtctataagctgggctaaaaggataagaagcacaatggttgtgctagatcggttgctgaaacaatcagcagcccagatgcttgctagcatttcaaaagttcaactgcatgactttccatttcaaattaatagatctaaaaatcacacaattctctgtagcaagaaatatgcctaaagattaagttttctctgacaattatcattaattttatcaatatatcaattttaattaatttacttatcaattattatttatttatcaatttataaatatatcaattttatcaaaataacaataactcattatttttcaacacagactggtcattttgcaaatgcatacttttggctataggaagacaaggaaaagttttttttttttacttcatggtttttttttaatctgtctcttaaaatcaaagaacagagtctatgacttattgatctatattattattattattattattatttttttttttttttttttttttttgagacagagtctcgctctgtcgcccaggccggactgcggactgcagtggcgcaatctcggctcactgcaagctccgcttcgcgggttcacgccattctcctgcctcagcctcccgagtagctgggactacaggcgcccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgcccagccgatctatattatgaatcagcaaaatttttctgtgaaggccagctaacaaatattttaggctttgtgggatatatggtttatgttgattagtggagacagctaaggagtattgaatgttacagacaaagaagatgcaatgctgtgattgagttctcaattataatacaataaatgtggctgacattatcaaagttacagagttttccacattgtgataagatcaaaagaactgattggtatgatttttttgccctagaatatgaacagggtgaaattatgaataagtgatgttaatataaagatttctttggtaaaattcttagaggtagaccatgctacaccttaaaaatttaaattattttgcctcaaataaagtttatgaaaattggcatttaatcttttattcccagagaagttaaacaacaaaaagtgaagttcagaatatagtaaataccatattataataatatgaaaaacattttgaaaatgattttaaaatattggatgagcaataaactaattagcatgaggatatgccacaaaaatgcttaacaagagtggcactgataaccctcaagaaagtttaaaaagaaagaaagaaaaagacaaaagaaaaaaataatcactttcaaattaagttatgttggaagtctgagaacctcctcttttctggggcttgttggaaggggacaaaggatggtgtgtgagccttgtatagctgcatggagaagacgcaaattagtgcacaaagtggttgaactctgaatgagttttcataatttaagctatgttattccagtgaaagagatgcctgcacataagtgaaaagctgcctagttaactgacagagagactcttggaaaaatttcccaccagacattgcttgctactatttatggaacagaatttcagtttcttaataccatcagaaggaaaaaattgttacatggtacagttggtggacgtggaagaatgtctcagggcacacattacaagtaaagcacacaaaatgtttgtgccactcctaaaacctactatattgcaaattctctggttccttaacttctattctgagtcaaacaatgaaagtactgaacacatttctacctccctcagaaaagttgacctctggcaactatgttgggtcagaactattcagaacattgaagaatccctcctttgactgtgacaatcgccccagaagttccaaacacaaagggaagaccacatggcttaaaaccactgattatgttaccaaagacatgactgaccctctcacacatttccagggaaaataattctcaatcttcctatataggtatagtctagtgacagttaccacaatcattttggtccctttttcctgtaccatggttaaatcatcagtggtaaaatataatagcacaatagttaaaaatatgacctcgtgagaagacttgagtactggcttcatggcttgttaaatctgtgatcatgtgcaagtaaattaaacttttcgacatataaaatagtctcatgagtttgttataagtattacatgtaataataaatataggctggcaaataatatgtgatcaataaatgccagcagtagtagtagcagttgttgttgttgttgttgttgttacaatgtctgttctataaatgatggagtaaagaaaagagaaatatatccaagccaatgcaattccatttgttctacccttctatatcgagaaattactaaaactattggcttatttatatgcaccaattgccaataacactaaaaaactgaaagcattactgcacaaaactagaatatgggcaattatggaaagtaatctaagttttatgatatctgtagaagacagggtaattgttaaagcttttatgaaagcaagtacaaacgttaattgcatatctgttgagattggcagagacattccgaagtagaatttatgtaatatgcatttcctctaaaatggaggcctaattgcttagttattctaaattgcagaatggaaaacaaaggagcagttttggccatgtgggtaaacaacagatttctaaaagctaattatctctttatttaatagactgaagttgcaccaaatgagacatttaagtctaataaataatagacaaattgtaacctaaagactaaaatataggagctgctcatacagtttttattgctccattaaataagctcttatttacttcccccacaaaacataattacacaacactgggtccatttcaaggccattttgatctgctatttaaaaatgatgtgaatcaacctacatactcaggaagtcttaaagcataatattgaattctgttagcaaatgccctatttgtgtccatgattaagaaacagaaatggaattaagaaaaagttgtgcataatcacataaaattattactactacttgccttactagaaatgattacacttaagaagagttatgcattttaaattaataaccactagggtctatgcttagtagttttcatgtcagatgaataggtactttttaaattaaaatagttcaaactcaagcatcaaccttagacatttactcaaaatttatatgttgattaaataaagacatcatgaaaatgtaacttgcttgtttatgtaataccaaaacattcaacagaaataaccaaaactgtgtatgtgaatatttaagagaccttcaggttcatcatttaaaaaaaaatgagaaaacaaaaacgaaaaacatcatgttttaacactataacatgaaaataggagactgctttcttagtttggttgctcagaaggatttttaatgcttcatttttcttcttggagaaatttagtccactatttttatctttattttcattctattaacaaaaatcacattctgaaatgatagtgatagtaaataatagtagatttggaaatagttgcctgttctcttgctgagggcaagtaatgatttactatgggtaagaaagaacaggaatttaatttactgtgctacctcagatagtgatacaagaatttctacacctgtgaaaaaattcagttcttatttgcatggagaaaatactaaagccatgaaaatatatggaaggaagctccctgtgggtttatggcagagttatgtgaagatttctctcttcctccatcatccaggggtatgtgccttacatatgaaaataagctaaaacaaaaagttcctggcccagtgaggtaacaaaacactaatgtaaattcaataattcacccttccacattcttttaaggctgagaaagtcgggctaaaaatttctacgaagatttgagcagtaccatgttctgtactaaaatataacacctgcgaagaaaaattacataaagtttcaactgatcctcacagtgtttaaaaaacacaccatattagcacatatagtacagcttataagcctggttatccaaaaaccacatacactaattatataaatcttaccaacttctgaggatttttattaaacaatatttaaactagaaagtttgatacatactaatagtctccttagttctctgagaccaaattttgttactaccaccagcctaagcagtctccatctcattatcctatcttattttagttcctgtaaattattatctgacattattttatatatttggttatttgaagcactcattagaattttaaacttcattacagcaggaacctttttattcttatttatcactgtaatctcaacatatagaaaaaaacttgatgaataaaagaacaataaaaagtggccttgctatatttcgttttttaccaataaaataataatagaaatgataacacatatttttataatagtacaatgtctttattgaagatcatatttgtcaaatatcatatgcataaaattcaatgtatcaatttaaaagtataaaaaactgatatttaacatattttcagtaattaagtgctaaattagatacactagtaacctctatttcataaaaccttcaaatgttataaaaatcatgacttgacaaaaagcatattctacatataatatggaaaaaagttgactgtattatttgtgatttttttaaaaatgaaaaaagttatcaataaataagcatgtagtaatatatttgttatatggttatatgactcacttggtaataagagttactgtaagaaatcaaatgctttgttcttctacattaataattgtgttgattttaaaggaaaactaaggaccatcatcatcatttattggggttttagaagaggtctttcactttggtgagaaaaatatgtgtttacaaatattatgaaatttgggctattatccctagattattttaaatcccacagtctgaaaaaaaaattcaaagttgacttgcaaaaatttcaaacgtttttaaaagacaaagtctcacagtagcttcttaaatcatagctgtttcagcatgttgtatcaaatgagttcgattacatctatagcaaattcatatgtatgatatagacatagcacatatctgtatttattttacagatatattactttaaacttacctattttaatatcatttatataaatctaagttactcagactatgctctgcagagggcacccctgaaaaatgttaaaatgtatgatgcatatgtacctcagcaaattacaggtttggaaagtcctattgggtgaagattttacatttacttgaggcccaccgatgttaatttgcagaccatgtttaggaagagatagtacagaaaaagtctaataaaataatccaataggtcaaataagatgagctctatgattaacgaaagatataataaaacgtttctttaaatctattgttaaaattaaaaacattcaagctttttttaaaattaagaaaagaaggtaatgtcatcaacataaaattacctattttaaagaaacataaaccagctattaaacacaattgatggctaaatattagaatgcttttggtaaaatttagaaacagatccttttatattaaaacctatatatcaaatatatgattaagggaagattataaataagtagagtacagtcatattataaataatcaaaactagaaaagaaatgaagttgatatgaaatcagtgaaaggatgattttctaaacttaaaggtgacagaaaaaaatcacaaaggcaaatattaaaacatcatagaatgaaaataaaagttttatatatatcaagatatagaaataaaaaagccacattagaaggaggtatttaaaatgtaaatatgaatacatactgagctaacttgtacaaatcaataagaaaaagataacaattcacaacagaggaactaaaaatgaacttataaacgctttttaaaagtccaactttagtaatactcaaagaaatgcaaattaagataataaaacataattttaaaatctataaaattagcaaaaatcttaaaaaataagaatattcaaccaaggcacaatcataacccaatgttgaaagttgagaaaattaaagttatgcttctgaaaatcagtttgtaagtatgcatcaaaagtcttaaaaatatccttttctattccatgtccaataaaataattacaaacattttctatttatggacaaaaagattaatcacattgaaaagtcagcaataactattgttccatgacttcattactgactaatgcaagttaaattgtatatggcacaaccagtggaatcaatcatatatatattaaaaattataagaattacaagctatgaataacatgaaacattcaaaagttcagcaacataaagtgagacactgaattgcatatttactaggatcatagctactattagaaggcagaaaaatttaaaactgaaagaacagtgtgcagaaatgtttacagtgattttttggataggaagattatgggtaacagccttttgatctactattttttaggtgttttcgataatgtaaataaatttgagaaataaacttattcttaaaagtgaaagcttccttagggagacataaatttaaattaaaacatcactgacattacattggaagttttattagaatttctttgccctatcaagtttcaatctttcaaattggtataagagagaattactgagacactctgtgtgatcagaccctgggcaaaacccacaaacaatacatccaatctgccatctagcaactcatctagataactatagacaacgctaaaagagctaatgttcaggctgggagcagtggctcacgcctgtaatcccagcactttgggaggctgaggtgggtgggtcacctgaggtcaggagttaaagaccagcctggccaacacggcgaaactcggtctctactaaaaatacaaaattagccgggcatggtggcgggcccctgtaatcccagccactcgggaggcttgaggcaggagaatccctcgaacccaggaggcagaagttgcagtgagccgagatcgcgccattgcactccagcctgggcaagaagagcgaaactccatctcaaaaaaaaaaaaaaaagctaatgttcaaacaccagaatcttctgtaaattaggaagtaatatattaatttaaaattctttccagaagcatattttaaaaataaatactaaatctttctgatctccatttttattcatacttaaaaataattctgagaatattccctgaatttcaaatataaacaagaaattgtgcttagatgatttttcttcccaggaagaaacaagtgcaatacattaaggtactcgtttcgctttagtaagcataaaaatatacctgtaaagtgaaagtaaagaaggcaaagtaggcatctctgtctattcctggggaaaccttaggtgaatttgcaaccctgaattgtaaactatggtgatttagcagtgaagcggatggattttaattaaagccttgttcaatccttactgacttggaagtagaaaagccaaatttttcagggaatgaaaatataactatattttacataattcttttgcttctaaataagtggtatcttttagcttcttgaaatacatatatacatatgtttctgtaaaatttcagtaccagtctctaaaagatactttgaaacatattgacaacaattttgtcatgtttacaagaaaaaaaaaagtatccaaaatgttcagactgcttttttctttttgttgtttttttgaaacaaaatctcactctgtctcccaggctggagtgcagtgtcaagatcaaggcatactgcagcctcaaccttccaggctcaggcgatcctcccacctcaacctcccgagtagctgggaccacagattggaatacacataaattccatacattacaattggctgatatgtcgcttaagtctctttcttttaaacaatgtttatcctccatcactttttttccctcccttgggatattttgttgaagaaaccgggttacatgtcctatagaattttccacagtccatttctgacagttactttattaactgacatacattattaaagattgattattgaggtagtaattaaagaaacgtgaatacgctggaacgaaaacagcataacagaggaccaaatcacctatgaccaacactggaatgaagacactacactactcgttagtaaatggaagggaaagaagaccataaagaaagaattgttctatggtttaattacagaaacaagtggttgtattttcctttttcactaagttcattaatatactaataaagcagcccatataaatcttaagtatacatagaataaataacaaatttgatagtactcaccagtcttcatttctaataaacgctttttcttttgttggcgttcgagtctttctcgctctgctaattctttagctattctgacacgtttttctttttcctctgcttctctttttttgatattctcctttattgcttgctaaaaaaattttgaaaaatgatcaattttaaccagtgattcatcccgcaaaatggaaagttatctatttgaaaatatgcttaaggtagaaacatgattatcttttagataatggtgagttatgttagtaatacagtcttctaaaaggtatgcacagaaacccttgttaactatgttatgtatctataaatacgactgttattaaacttaaacctgcatctttaaaacatccacatcttgatggaattaactacctaaaagggagatgggagacagaaactgaaaataaaaaaaaaactaattcacaaatcaaaactgttttctcatatacatttccaaaagtgtctagcaactgaattagggttttccacatcttctttgcaaagcaaattatcaagtacaagaaaaattatcaaattaaagacataataaaagaagtgaaatcttgtagtggctactttttattacaatcatatatgaatttttctaatatagagagaaatgtcgtaaaggtaactaaagaaatatttcttggccgggcacagtggctcacgcctgtaatcccagcactttgggaggccgaggtgggcggatcataaggtcagtagatcgagaccatcctggctaacgtggtgcaactctgtctctactaaaaatacaaaaattagctgggtgtggtggcgggtgcctgtaatcccagctactagggaggctgaggcaggagaatggtgtgaacccaggaggcagagcttgcagtgagccgagatcgcaccactgcactccagcctgggcgacagagcaagactctgtctcaaaaaaaaaaaaaaaaaaaaagaaatgtttgtcatttcaaagccaggtcctctggctttgatcaaaactaataataacatgctaatcataagaagatctcaatagatatgtgattatttgtttaatttcttatttcttaagtgttatacacatcaagaaatacctctcatgtggcattaaggggaattagcaggtaaacatgggatttttaagtgccaacaaagagagtaacattatattaaacaccaatgaaaccaaacaggttaacacattggacgtttatcaccactggtattaaatagaaaagtgtgtaattaaactataacaagtaggtggcttatgttgtttcgggagaaggcttttatatctttactgtggtattctttattttaaccctagagttagtacaagttcttcattaaaaatcaaataataaagtttaatatttttgaccaacaacaaaaagaaacaaaaagcacagagtagaggggacagtaactcatgcatgcatgcatccatccatccatccatccatccatccatccatccatccatccatccatccatctatccatcgatccatccatccttccatctatccaattaatacttactctgggactactaaatagtattgttgtaaagtaggggagaaaaaaaaagagagagaggaaaggaaggcggagaggggagaaggaagagtgcataagagagcacactaaaacaagtttacattctatatggtagggtgcggcaggaggcagagataaataataaataacaacaacaaaataagagtgccgtgatagcattcctgaggggttactttacattaggtagttagataaggtctcactctgacttgattcaagctgaatcttaaatgtcaaggagctaggtaagtgatgatctagaacacatcaggcagagggaagtgctaatgcaaaggttgctgttgggtttaggagacagaaggccagtataaaggtataagatgaggtcagggaggtatgctgaggcctgatccctcaggatcttctaggccaagacagggaggttagattttcttttaagcgttctggaaaatgactagagattttcaagcaagtgcaaaactacgtacactgagatacaagaaccaaccaagcacctttgtttcgaactatcttttcaaagatatttgcataatgaacagaagatagaggtagtatctccctcctaagctaaggggtttgttactgcccagaatgataaactggagcaaaggctggacagtcttactacctattataaaagactgcattccctaaattcaggatttccctccgatgacacaaaccactgtgtatataagtgtcacctgtccctttcctatagccctgtgggagtacgggcgcagaaacctaaaaaaaaaaaaaagtttaatctggctattgctattgtgtgagtagcaaaggattctttgtctctgaccccacatccatgaaatggtgtcaagttaacttgttagcctgttagtaggtaaactctcaaactcttcacagttcttgacatatataaacgctagttattattgctaagctataaaataccagctgcaatactagatactttaatgtgcaatccctttaattctcaaattggattctgcattctctaatctggcccagagtggttaagtacttgtttactgtaataaaagtagtaagaggcagtaagttgcaagatttgaaagctagctacagtcagtggttttccaccatattgcttcatattatggtcatgtatattaagaggcagctatgagacaaaagttgtaataaaaatcaacataagaggctgggcacggtggctcatgcctgtaatcccagcactttcggaggccaaggcgggtggatcatgaggtcaggagattgagaccatcctggccaacatggtgaaaccccgtctctactaaaaatacaaaaattagctgggtgtggtggcacacacctgtagtcctagctactcagaggctgaaacaggagaatcacttgaacctgggatgcaggcggcagaggtttcagtgagccgagatcacaccactgtactccagcctggcaacagagcaagactttgtctcaaaaaaaaaaaaaaaaaaattcaacataagaaaggtaggagaagataatcatgggttcaaagacaagtgagtatatctgtatgtgtgtgtgcatgtatactcatgtatgtatctataagggagatggggtaagaagataggttgtgatagagaaaggaaaagcaaatattcaggaatgaaaattctatttcttgcttgagagaaatgaacaagatgaacctacaataaataaataatatatcatgtagcttatttatgagtctaattaaggtataacattttctgatgtgaattttctactctaatgactgaatacatttaaatgtgagtacataataggcaatctgctatcagatataattgccacacccttttagcattcccatgggtaataaaaagtgaaaattacttttccaagacctataaaacaatgtttacatttagaaataaggtctaaaggagttcttaaacctattttgtttcatgaaaaatgcactattgattttcatttaaaagcctacttcatttaaaacataccatattctcatattgtaactattaggagaagaattttagctgaaaaaataccaatagagagcacagaaataggtgagtctgagactaatatccgagttcaaacagtaatttgagattttcttttattctaaatgttaagaagtaaaagtagcttaaaacagaaaaactgaataattaaatgagaacaacatttttctggatatgactgcctcttagtgacttccatcctaaatttgaattaagaaagaaaagttaagggttagccagatataaagacaattggctataagacattgattttttaaaaccatcatcttttcttgaccttgttttatatttagtcagctggcaaataaaccgcactgcctccaactactttcagctacactttgcctaaagaaattctttgagtgttacttgccagacagagtttggtgcaacccccttaccctccaagtggaatgataaccaccattctattctccatttctataagtctgacttttttatataccacacgtaagtgagatcatattatggtatttgtctctcagtgaatggcttatttcacttaatataatgtcttctggtttcatctatgttgttgcaaatgacagaatttccattttttcatttaagtctgaatagtattccattgtgtatatgaaccacattttaaaaatccattcattcattgttggaatcaacatttttgaacagtatgagttggagatccaattcacttttgcccatcctttctccaataatatgcaaagtcacttcttttggatttcaattagcacatgtgtgttgcttcattttatggctgttttagtccatttgatcaatataaccatgtctctaagaataatactctattttaattattaaggcttacatcttatttttcttacttaggaatgccttctgtatccttgggcctttgctcttccatctgtattttagaatagacttgttaagtttcattgaaaaggactataagcatttttaattgatatcttcacaattttgagtcttctgtgaacagcatgtggctttttattaacttggatctttaaaaaaagctttagaaaaaaactcattttctccattcaggtcttggacatttttgttagatttactctctatacatttcttttgctattgtaaatggtgccttcttcaaaaacaatgatttctattgttttgtaacatataaaaatgtaatttttactttttgtagagatgggggtcttgataatattgtctaagctggtcttgaaatcctgggttcaagtgatcctctcaccgtagcctcccaatgcgctgggattacagggatgagccaccacacccagcctaaaaaatgtaatttttatatatgctactgataatttttcttattatttctgatagttttcctataggatttgtttttgctattcatagagtgctataatgtcagcttgattttctcccttttcaatctttacattttcaactcctacttgtcttatcttgctatactgactaggagttagattctaagtattaggttaaagggtttcctttgactcctttcctactttggagtagggtggagggttaaattagttcatggttcttgttttgaaatctgaataggattttctgacttgactgagagaaatttcacaattttttttcccattagactcaatatagtgaattatatttatgaatattctaatattaagccatactttcacttctaggataaactcaatttggacaggaagaatttatctttttgaacatttagtcataaaatacatttttgtattccatttgtttgagataatcatttcattaaaatttggtaaaatgtatctgaaaaacttctaggccaagtatttatttcaaagattaaaagtcattaaaatcaaaattagttatagaactattcatgctttctatttcttttaaagtaatttcagtaagttatttttgtctaggaacttatccatttcatttaccttttccaatactatcctacaaatttttacagaaagctcctctctttttactattttctgtatctttagttatgttcctttttatatcctcaatattatttatcttctctttttcttgattaatctttttagcaatatatctaattaacttgtcttttcagaataacctcatttttgccttttatgtcactttttctttcatttaatctttcatatccctccttctggtttctctaggatcatataaatcctttttaaatttctgaagtcagatgtttttaagtctttctgataaaagttattttattgatacataatacatgtacatattttgggggtacatatgataatctgatacttttatataatgtgtaaagatcaaatcacggtaattggaatatccataaccttaaatatttatcttttatatatgtaggaacatttgacttattctcttaagcacatatggtataaatttataccatttttactgcatccagcaaagtctaatgtggggtattttcaatattgttcaggtataactgttttctatgatttcatctttgacatatgactttttaaatgtgtttttagaattttcaaactagaggttttaaaatttcatccttttaattttatttctaatttcatgtcattgtggtcaataaataaataaaactggcactgaaaaatgtattgagatttcatggtctctagtatgtaaccaattttataaaagttcaacttgtgcatgaaaaaatgtgtattctttaattatcgagtttgaattctatatacactaatcaaatcaagtctgttaattgtttaacgcttgtctttaatgatatttttctgcttatcagtaagttaaagaactttgttgacatttcctaacataatcctaaatctgtcaacttatcgatatagtttattaatttttacaatgtcattttggggctatgttattaggcacataccatttttaaattgttgtatctttcacgtgaattaagctttttgttgtcatgaagtaattaatgtcttgagtcaattgtacctattaacatagtttccctttcttctgattaatagttgccttgtatttcattaactgtcctgttacttcaaacatttctatatccatagggtaaagggaggtctcttataaacagcataaaaccagattttattttttatacgatattacagtcctttaaaaaatttattgtgatttataaaatgtttgtttccatctatttgtctagctttagttatgcctttatttttcctgattttttttggtgtatccttcttagtctatttctctcactacagtttagaatttatacttgatatttctatcctttcactggttatccttgtatttttattacacaaataaatttttagcaacttaacaagacctaaagttaattaatatctgtatctccctttctcccttgactaaaataaagaaaacccaaattctaaatctctctcactcaatttataaatttatgtaacattgttttattgtgtactttctttacatttgttttcatagtacctatggcttcctgtctctcaatctgttttttgttgcttctttaaatacaacctttagagcagaggctatcgaactataatccttagattgaccacgtattttgtaaacaaagttttactggtacatagccacagccgtttatttacatattggatatggctgcttttgcactgttacacgagagttgccacagagactgtattgcctgcaaacctgaaatatttactatctggctatttaagaaaaagttttccagtctctgaaaaaaaatcttttaacataaggatgttgatgaaaaacacttttgtttcctgtttatctacaaatagtagataattccacctgtgctctataaagatcttttgctggataccccaaattagaagaacatttatgtttgtgcatcacttaaagatctcactctcttcagccttccatttttgcaataagtaatctgtatctaattgttgttgctttgggggtcatatcttttctctctggctgcaattttttttttggctttagtgttctgcagcttcattatttatttgaagtgagtctcattttatttatctggctttgtataagttgtatttcctattctatggattgctgatctggaaaattctaagccaccattttgaatattgtctttcattctttttgagtctattcttctgggactttatacaagtggtaggccttgtcatcctgttctccatgtttcttaagaagtattttacacttctaattatactgtccccctggtttgcattctggacaatttatttagatgtattgtgcaaattcaccatttctttccttaagtgagcataacctgctctttaatccattgaatgttaaatttcaaccaccacacttccatttccatacattctatttgcttttttcaaaactgctcctttttagtattctcctgttactttttctctttttaaaaatttcatgttctatttccttaaatatttcatatattgttactaaatatctggggtcttggaggcctatatgtattactttttctgatcatttcaccaaacaatcccttgtttctttgtgtgtttggtggttaggattgagtgttcttacttaattgaacttaatttgtgagaatcttgaggacctaaattgtaactgtcctctggcacagatttgaatttgcttctgtaaatagccagggatcatttctaacctgaataactttaatttgcttttgtcacaggtttattgtaaacattttattcattgtattcaccaagttgtagtcttggttttcattcccagggcaggcctaactttcccctttgctcacctgtgcttattgttcaggtttcaacttcattctttctctttaaccacttttgccttggagatttccctaattttctcacaggacagccacgtttttaaaatagtttgttgtattttggtgggatggatttttaagagtccctagtaaatcgtattgtgataagcaaagtcctcaaaagtatattgttttatagggttgaacaacacagatatcttatttctaaaaaacgttcatataatgtagcagttctcatacagtatgtatttcgggggatactttatacatgtgtgtttcatgacccaaaggttgcaaacaaacaaacaaaaaaagggtaattggacagccatatcaaatgagtcctgaacaagcactcaaaaaaatactgtggaactgaagatcaagaatgccttcaagaatacattaagtatgacatttcatcacttttagaagttgtaaaaaaaaaaaaatcaatctgagcttattgctgcatattataaagacagtataataagagggtagaaattgaaatcatattgtttggtttaaataaccacctagcactaaatagctgtgtgactatgcctcagtttcctctactgtaacatggacaaaatagtgcctgcaatacaaggatattttaagaaataaatgaaataatgcatgtaaatagcttatatcattgcctcacacataaattttagccctatataaatgttaacaagtattattatttctttacaataacatcaacaattttttattattacagtaccattaatgaagtgcctcaaacacatttatccagcaacaattcaagaaaaaaacatatgctggcttatatcaattatatatgcttccatcaaacatatgggggagtgccaattttcatagttcctataagaatatgaatgctttctattcagagatattggaatacgatggtacactgagctgatcaggagtaaaatggttgcatccaatacaagctgcatcacttggcaggaaagctatagtggtaaattaaatatggaaggcaagatgtagttctcaacctcaagtctagctattatacctctgaagatttaatttacatatatatgcacattgtttttaatattctaaatctaatgttcattatgagatttcattctggaaaaaaagagttagctttcctgtgttttctccacgaaagtactactttcacttgaaattagatattcctaaaaaattaacttaaaacactgcccaataatgcaattaacatttgttttatatttttccctaaaagtgcaatttaaaaaatcaatgtgcattttcccctccttctaaaaaaagcattataaacagcctatattccaaataggcctttacttgacaggtatatcagtcttattttatgttataaaataaaattttaataaaacaaaatataaaaatgatagcattaaatactatttagtgttataatagtattaaatactatttaatgttataatagtattaaatactatttaatactatttatttaactattaaagtaggctgccatagattctgactttttgatcgtacttcatctctatttcagtctcagcccatttaaacagattcgcccacccaactcaacatttttcaacatattataatatcctgtatatttttgcgacatagaaaactaggagatttaatcatttgaaaaaaagttgaaaagcttatgaatgtcttcttgttcagagttctatttcattcaacattaatggatactcaagcaatacaagtcagggatctctttaacacaggtttcactaaactcaaaaatctttactttttcctaagtattcaactttgtctcaagtccctaaaatgagattagattagacaaacctaacttaagtctccatgttttccaggggaatgacagttaggtactatgaaaacaagactaattttctcagagtaaacaagctcatgcaggtctcacacattcccactaaacaccttgcttagggttgtttaaccttaataaaaggcaatgcttcaccatacttaattactactttctagaaactcctgatgacttcagctttaggaataattggaaaacattttaatttggaaaaaatccttaaaaatacatttctgtattctcatacatattcctgtagtggaacaggaaaaaaaatttaaaaaattaatactagtcaccaaagtctgtcagaatatagaaattacgtgatctacttttcagttttccattaaaattattttctttggtaactaaatgtaaaaatgtaaaaattttccccaagtgccaaaaacaaacttattatagctactttgtggaaagtaagtttattgtaataattacaagacagatgttttagaaagaaatctagaatgacagtaaaattaatcaaaataatttttctagtattaccaaatccaattaaaaaactgttatcaatgaaaataggagaacatgatatactgtgctctggcacaaacaattcatcatcttaacattcaatatgcgttgctattagttgaactttttatgaccgtgaaacttatgaaaatgggaaactatcctttgaggaacaaactagaatatcccaaaggatgtgcaggtgctgattattaaactatttcagcttaagttgctatttgttgtaaaatcggtctcaggtaaaacaacaaattacttattaacccatcagggatgtaacattactggcccttcttaactttgctatgagtttctttgcaatctcttccacaattcgtaaaattttcaagtaaatgagatacttcaacctattcacatttctttaatagataaagtataagatgtttgtaataaagtttttcccaaagtataatttgatttcccattgtgtgttctcttcccttttgttcagaagtgatatataataaaaatattatttttatctcccaattacaaagctaaatacaagcacaagtcgctatgcacaagatggcagccatagtgtgcttaaaggtaggcttgctgataaggcagcagttttttgagttgctgctaaacacatattcaagggaaacatccaactaaagtcccactagtctcatatgaacctaatttatttatttatttatttatttttttttgtgagacggagtctcgctctgtcaccaggctagagtgcagtggtgcgatctcggctcactgcaacctccgcctcctgggttcaagcgattcccctgcctcagcctcccaagtagctgggactacaggtgtgcaccaacatgcctggctaatttttttttgtattttagtagaggcagggtttcaccatgttgtgcaggatggtctcaatctcctgacctcgtgatccacccactcggcctcccaaagtgctgggattacaggcctgagccaccaggcctagccatatgaacctaattatgtttaaaatgtaacataaaaaatagccttaagttaacatgtatcctctccttctatctctctgtttcctcttgtctctatgtgagggtgtatgagaataatctagaaaaggccactgcatttgatgtacaaagaacataccattttattcatttttttttgtggtattctaggttgtcacctttttaattacatgagttaatatatcttattattatgtattagttattaagttgatttcttttccctatattatcaatctatttttattctcactaccgtattagaataatctaggcattaccttttgctacgttatttcagggaacaaacaaaatactgaaaatgtggaaaagaaataaaaattagcagttattagcagtcatacagaacctggcagtcaaatccagttattatcccatttagcaatgcatagtacgaataaatcttaccaagaaagaaaagtaagccaattagtaaaggtctgtttttactgtgaagaacttaaagagtaaagactaggagaacctatcagaattaaattatttttcaaagttgcaaactcaaaatattcagcacctgaaattgatctaattccttaaataaacaaatactaaaggataataagaaaaacagtcttatagttagcatatttattttgttctaggtttgtggcatttagctccaagtttgatctcagaataacaaatgtgctaatgaagacataagtcttatgtgaaaagactccaaatacaattttcaagttgtaagcccaccaaattaagcaaggatagaagatgcttcctattaaaattgcaaaagctggctcaacactcgaccataggacttgtacatgattttccttcctctaacacatataatgagtcaatctacaagatttaggagcacacaggaaatgcttagtgttttgacattccttttgatgatctagttggtccacacagtagtcagcacaaatggcatttagagttgacaaggatcaaatttgtgtaatctaaatgatttggcaaaatgagttttgttctggctgtcctccctatcaaaaacaattttacactaaaaataccctctgactggatgatttcatttttgtttggcacttcactactttagtcggagaattcagtagaataataaattatatttgatcaacagatgcagcaagattaactgagttaaaattgattttatatttgttcacaacatagatttcaattttataaaccaaaaattgacttaaagtcggcaaacagcacaaatgacaaatctttatctagatgaaacataaatttaacaaaattgtagaaatactctaaagccagagctatacatgtgaaacaggtagctatttatttatttcacagtattctatatgggagcataaaaataaaaaaggataaaatacagtatcaatcctattataatgagattgaaaatgtaaaattactgtacttctattatttgtacatggctaacttgttttgagggtatatgtatgttatgtaatttgattttcaaaaagtaacatccctaagagatgcaggctgttattatcagaaaactgaggctcagtaaggttaagtaatttgcctatacacgtatcactaataatctacagagaccggactcaactccaagatgctctgatgccagaacttgcatctcaactactgctgtcttcccactagaacggcaaacagcaaaacatcactattaataacaaatgaattggctgaggcctatcataggcaggtttcatcaatcacttaagatttgaagaaatcaggactaatcatgtctctctttgagggtcatcacaggcaattaagatgggagatatatataggaaattaagttacgggagaaagagactggattttatgaactagaaaataataactacaaagtttggcacatatgtctatacccatctacaaaaaagagaacaccaatataatgcttctccactttttgtgtgcaataataatcttttttaaggcagggatttttttgttgccctctaaatcttaacctcaaagtgggatttccagatattcaaggtcttagaaactatgagtaagaaagaagtgtagtggcctttttcagtactttaaaatcccatcgggaaatgttcgtgtgctcaaaaataagtcacagaaataaaaatgtattctatatgagaacaggtgatattgcaaactcagagagtccacataacagctacatatgtctaactaaaacagaaaaatgacacatttattttatttattattattatactttaagttttagggtacatgtgcacaatgtgcaggttagttacatatgtatacatgtgccatgctggtgtgctgcacccattaactcgtcatttagcattaggtatatctcctaatgctatccctcccctctccccctaccccacaacagtccccagagtgtgatgctccccttcctgtgtccatgtgttctcattgttcaattcccacctacgagtgagaacatatggtgtttggttttttgtccttgcgatagtttactgagaatatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgtacaataaacatatgggtgcatgtgtctttacagcagcatgatttatagtcctttgggtatatacccagtaatgggatggctgggtcaaatggtatttctagttctagatccctgaggaatcgccacactgacttccacaatggttgaactagtttacagtcctaccaacagtgtaaaagtgttcttatttctccacatcctccccagcaccttttgtttcctgactttttaataattgccattctaactggtgtgagatggtatctcattgtggttttgatttgcatttctctgatggccagtgatgatgagcattttttcatgtgtcttttggctgcataaatgtcttcttttcagaagtgtctgttcatatccttcaaggctggttcaatatatgcaaatcaataaatgtaatccagcatataaacaaaaccaaagacaaaaaccacatgattatctcaatagatgcagaaaaggcctttgacaaaattcaacaaccttcatgctaaaaactctcaataaattaggtattgatgggacatatctcaaaataataagagttatctaggacaaacccacagccaatatcatactgaatgggaataaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcaacccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatgcctaggaatccagcttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacaaaattggaaaaaactactttaaagttcatatggaaccaaaaaagagcccgcatcgccaagtcaatcctaagccaaaagaacaaagctggaggcatcacgctacctgacttcaaactacactacaaggctacagtaaccaaaacagcatggtactggtaccaaaacagagatatagatcaatggaacagaacacagccctcagaaataacgccgcatatctacaactatctgatctttgacaaacctgacaaaaacaagcaatggggaaaggattccctatttaataaatggtgctgggaaaactggctagccatatggagaaagctgaaactggatcccttccttacaccttatacaaaaattaattcaagatggaataaagacttaaacgttagacctaaaaccataaaaaccctagaagaaaacctaggcattaccattcacgacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcatctgacaaagggctaatatccagaatctacaatgaactcaaacaaatttacaaggaaaaaacaaacaaccccatcaaaaactgggcgaaggataaaaatgacacatttttaataagtataatttggtagaaaaattattttgaaatagattacccgtaaggagttctgcaacaaaggggtgtgaagaggatgaaagcattaggaagaatttctttaagatgaaatgttaagcaaaacaagtaagatgtcagatgaaatttgcttaaggagataagagtgttgtactttgctaataattttggataaggaaagagaatagtaaaagaactttcagcaaagttgggctaatggattaattagtacaggcttccacccgtaccaattaggagaagcatcacctggataacagagcattaaagaagagaccatgtagtttgggttatgtgagaaaaagcaattagatcaaaatcctctaatatgaatggaaagtgggaaccgtacatacattatgcttcaaagccacagtgaccaatgaaaggcagaaaaattaggtttaaactcaatggacaaacatgaacacgctacagctgttggatagattaaggaggatgaggttgctcacaagatccaacaaaaattccatgagctcaattaatcctgtagaagcatgatatcatttgctaataacaaatagattggttaatagcatgcagtgaatctaaaaccagtcacaaatagaaaacaatgattaatgctatacaacactacatgaataaaggtatgaacttcacttggtataaagcttgatgcccgatacgccaccgatttactcagcatatagtatgaggtcagatatttccacctagtacctccaatctgaacttttgtcttcactcaagtcttacagtaagtaaaaatctattacgaaaagatgctgaccctctatccttcaccttatccttcaccccagcaaccaggctttacattaatagtcctctaattttaaaagaacacatttcatgttttgaaatagaagcagatctgaaaacattcttctatcatgaacccatcaatgtaaatagacaattattatacccaaggagtatgaaaagaaagtatgccctgtgctgattctctctagtaagttatcaaaaacactcttaaaaattacaaccttggcttttcttgcaaactctctgagcagcaatgtacctgaagctgttaaagaacaggccttggagtcaggcaggcttccattcagtcttagccctaccaactctgaagcttctctgcaaagacatggagcttctctaccctgcagttatctcacctgtcacattctggacctcaaaaaaaaaaaaaaaacactgaaagacgaggtgggacactccatgcaaagcactgggcactggatctagtaagaagtaacttcaaaccatgacagttgttttggttttgttctgttgatcatggtaacaaaaataaagctaaagaaaattacaatgcaaacttactccctatttcttgggaaactgatcagtagttcaaaatagaaccattcccaatgagcacattatctacagtcgattgtttaaaaaaaaaattaattcccagttgagaattctcaagtagaagagaagtgagttaaactgctgtcaaaataaacagctgttcctcagagaagctacaagattttgaaacttttcccccttgttctacatggcttgaggcagcagtctggaacagatattccttctttagctattgtaacaaggctctcatagagcaaacaaaaaaatgaactcgaagggctgtatctatacatattagtcgtgagattctagaaacactgaggagagactgtatgagttagtcaaaggtatagcaaaaagcttttaaacccagcctttaactacttaagtttaaatcccaagacaatcttaaactatacatattttagatcaattatttacaaaccaaacgattgttccaaaaaaatggccactttttcttttcttctattgggagaggggttaggtttcaagctagtcccgtttgacacagcaatagcagttatgcatttaatagatgttaacgcaggtcagccacatatggtatagactgtggagccagacagcctggaaagaatcttagctccttggcagctatgtaatgataggcaagtcaggatctctctatacctgtttcctcatctgaaaaatgggaataataacagtacacataccacatttagttgctactataaggattaaatgggtaaatatagctccagacgcatggttagctctatatatgttagctattaaatcacccattgatcatctgttactcaacaaatttatctattatatgccatgaattgcactagagacagaaagataaatatgacagacacagatcttactaaaggaagaaatgtctgaacagagattagagggatgagtatgataatttagccaggcagagtatggagaaagtgctccaaacataggaaacagtaagtacagtggtctgaacttgagagaaaacattgcatggaaaactgccaatgggggagtaggtatggagtgaagacagtggttccaacccctgatatgtaatacaaaaattagccttcactttatgataaaagctcattcatgaccagaagtatacctaaatgccagtggatgaataaacaatggaaacattttaacagtactttttaagaagaaaatttttgtctattaatggggatttccagaacaagatcttcaacaaataaaactctacatctttctttagctacatatctaagatttccgtagtgactcattcacattaacctgattttcaaagttgaataatacggaattaaagagcaacctaagagatcagaagaccctgacaaaacgagacatttatttgtcaggagtttttgccaatattgctactctggacttcaaagcgatatattttgtctaaaatttaaacaatataaccatatttaccccccaaaaagaaagaaaaatagaagagaataaagtacctgtataaaatctcacaaccttgttacaatcacttcccttccagccttcatgcttatttttctcctaaataaaatttcttctatatactattctttagatttaatacattttaatatttaatgttaacaattttaatttagtgcagtgtacacatgaatgtgtgtgtggtggtagtgacttctaggaccccatgagaactctgaaacaaagtagagctgtcactctgttacccactttttggaacccttttcccattcaaacactttctctctctgcccactatttgcccacatgaaatgccaagttacccacagaatgccaaaaccctctaatccttttagatctatttacctctattatatgcataactgctactgctgtgtccaacaggactagcttgaaacctaacccctctcccaatagaaaaaaagaaaaagtggtcattttttggaacaataatttggtttgtaaataattgatctaaaatatgtatactttacatagttgggatctggattcaaatcccaactggatcacttacaaacaatatggcattgatctcatttggaaaccctccaaacgtcagtattctaatttgtgaaatggaacacaaactgtagaatacaagaggcagcatgacataatgtttaagagttagggcccttaaagaaggctttagagaagattatatgggtttaaattctagttcgaccattttatagcagtataacactgagctggatatgttccttctctgtgcctcagcttctttatctgccatagaagaactgtgtggcttgtctgacatactatatgtaaggcatttagaagaatgcctggcttatagaaaatacttagaatagaaggatattattacttcatatatccattttatacttgatgcataattgtgtcagaggtccccaagacaccctcatgtttgataatttgccggaagggctcatagaactcagaaaagccattatattcactgtgatggtttattacaaacactattaaaaggaaaaatgtgcaaagggcagtcttcaggagaaaccagatccaagtttcccattgccctctctcagtggagtccaacagacaatgcttcatcatccccaaaacaatatgtgacaacatgtacaaagtattgcaaacctgggaagcttctgtgagtcttggtgtcaaagattttattgagagtcagtcactttagcatagactgcctggaagactaattttagctattctatctccagctcagtaagaggtcaaatggagacagtgtggcccagggccccaggtagacaaaacaggtgttcaacataaatcacatcattagcatatctatataggttggcccaaggccccaggtatataaaacgcccttatcaggcaggatatttctaggtctcttagtagccagtcaggggccagtgttctttggaatatgaaggttttgagcaccccaagcctgctgaattaaccctttactgtataataatttattgagcaactaccatgtgccaggagctatgataaacattaaatatatattatctcatttaatactgaaaacatttttatggggaaggaattcacattacttttttaaaaccaatgtggaaactgaggctcaaggttaaacaagtcttcagacacataactcgtatgaaattcaaatctagctctctcagactgcaaagtctttactatttccactaagccatattgctttacaaaacattacaaaatttaaaataatatattgcaaagtatgtgacacatacaggtatatcatatttattaaccaaattcatttctggcaatgaaaaataatttacagaattgctttgaatttgtggagaaaataaattagaactgtgaccaaatgtgtatttttcctgtaaattagttttcctttaaaaatagtgtttttattaaaaggctatctaatcctaactaaataattataaccaagtccaacaacctcagcaataaagttttcctgagattaaaaagaaccagttctttaaattcaaccttctttttcttcacacctcaaaactttttaatcgccacaaacaattgctaaaatacagaaatgacttacccatctattaagaataacaatttttcattgtagaaatatgtcaccagtttccctagggaggcaacaatgccttctcactttaatatgtgtgtagttcttttcttccccccacctaatcagctaatatgtttgaaaagatatttttaatgcctaaatgaaaggattccacatcaaagacctgacctccctattaaagtatcctaaaggaaaccctacgaatgtaaaacctattcaaaggcaaattgcgtgtagcttattgtacaatgcattaaggaaaaaaagccttacaaaagctgcaaggaatttggtaaaattatatcacaaaaatataaactgatcttgaagtataaagaaacaaattcatagccaaaaacttattacagaagtgctctgtaattagccagcaagggagtctttatgaagaacttcagaatttgtcactttttcaatcaaaatgtctgattacagcttaatgttggaaaggccaaaaggagaacaaaccatacatttttcaatagatttttaaatctgaaattttatagctttcaaaatcagaaaagataggttttcctacagcaacaagagtagaacgatgtaatgagataatagataagatagtataaataaaaaaactttttaaaaaacaatttttttaccataccatgaatgtggttctgaagttattcaggtcagtaagaaagtcttccacagacaccttcttcacatcaatggcatagtatcctattatactctggtataacttttccatgttttcgtgtaacttcgaaagtgtctcatattgttcttttgcactgataacaaatctgtatactatagttaaggtattctgaaatttacaaagtaatgctttgggggcagggggaactctgtaaatccaatgttttagtctaatagccaccattactatatttccaaaattctaaaattacttctaatagttgaccattcttaaagtcagtctatactacatagcaacaaaatcttaaattcaatttccaattaactttgggaaatcattagaaaagatttatatatttaatatttctctttaacaagtttaaaaaatctttcttccaacttactataataatataatatgcagatcatacaatatgatttaaaattatagttcagtagttgcagctgaataattgcaatgatattgaaatcaacagtacaagcattaaacacaacagttaaattggacatcttgggatcaatttctagctcctatacttggtaatagtgtgcctgtgggcaagtgccttcatgtctctgtgcttcaatttcctcatctgtaaaatgggaacaataatatcaccaactcacagggctattgagaggactaaatgagctaacacatgcaaagttctcagaaaagtgggcatttagtagcacacaaaaatacttgttatcatcatccctcacttattttaaactttaaggttctaaaagcaaacaaaattttaagagttaaactgaaaacttctcccattatctaaccaaattagtgttccaacttctcttagaaaactggtatataatttctttatgcattagattattaaaaattatgattacacacacaggcacacacatatagaaacgttcttctctcactcatgacaatatatttcaaaacacactgaaattaagaagatgaatttaatgtgaatgtgacagccactgacattagaaaacattttctaaataaacaatgaaattttttttcttgtgtggcaaattgctaatgcagtcagatataacatcactataccatatccagaaaaaatgattcttttagagcatcactcataattgcctatggctcctttaaattaacatttaacgaaatggaacatagttaaatttgcagaagtccttttactaactttgactagccattagcaaaatttaaaacaaataaaaaacagtattcaggcaggccaagagaaagaagctaaaaatggaatttttatatctaaaatttttttggcccacaatttcaaaaagatatggttcttctggccagaacttacatcagtagaggatgaaataaggaaactgatgcaggtccttttctttgagaaaaataatgaaagaccaaggaaaaaagagacagcactactgccaggtagggagtaaatgtaggctagcatatgaaagaattctaattcttcatcatcatcttcatctaaaagaaaatgcaaatgtagttagctgtccttgtgcaaactgttaaactccaacttctgtattcgtcaagagctttggaaaaatacgtgagatactcaacaaaataaacatttcataaaattcattataaaaatattgatataagcccaattacttgatgttttgggaaatctattttgttttcctttaccaacactgaggccaaattctcatgaatttctactagaatcactgtcatcttcccatttgagaggtagataacaaccagatctgtgtttacatgcattgaaccacaagtgttaagtgttggccagctatgacttggaattctactcctggtatgccagtattgctcattaccaaaccacctaccacaaatatatcccacatttatttttaggtcatactgcctttattacagttctgtcactgaggatgcccataacttccattaacatactttataaggatcagcatcattcagtcctatgtgtctaatatatttcatagactttcttaagtacacaggatccagcaagccattcagtaagtattatctgagttccactgtattctaggcactaggaaaaacagtagctaacaagtcaggcaaagtccttgctgtcaagaaacattttagagtatggagacagataataaacaaatgaatcagatttttaacatagtaataagtatgatgtagaaaaaaaatatgatattacgtagagtgacagaggttaggtagttaaaatcttggctaagaaagtgagattgactaaaacaacagaggcttgactgttaaagagcagtgagctgtccattgggtagtactcccttgtaggtataagacttcagaaaatgaaaagattattataaatttggggactcagagagaattaagaacagcacatttaatgctagttttaaaagtctgctaagaaggaattaagtggaacacaggcaagaaagaaagaacagaagaagaaaaggagaagaaagtgagaagactaattcaagagaagaaaaatctgctacaataaatcacccaattgccccacttcccactcttacaactgggccgtgtattatacaagtttacatttcatccattccaatcttctattttacttcctagtcgccacagttcaaagttcaacatactaaattcctttatctgaaaaatgctgtacattatgcagtgtagaatatagatataagtaaatctttctctcaatgaatttactgggctggctttagcatctacccagtgatttcagaagtttctaaagcattgctatatagaataacacacaaaaaaagtgtgaaaataaagtgggatttcaatgaacaaatttaaagaatataacatggaaaggagtcaagtaacttgtcacataagttgtaataaatacagaaatatataaatgtctagcaaaataagtttttctgaaagactcaggagagggagtaggaagaaaatagaaaggcaagtgctcaggcaagaagaatttcaagtgcaatgctccaaattctatttgttcttctccttaaaataagacatatcacagaatttaaagatcatgagaaaggaacaagcactacatgacacaaatcctggcatattcttaattttctcaccgataaaaatttagtaagtacgtacacctcacatataatagcttgcatgtaacaatactgatatacattgaatttggtttcacatttttcaagcaagtagttactgtggaaatattcaattctaattaaggctctgactagacttagcaagtgggaggtaataattattactaaaatgtcaatgatatttgaaataatagtgcatcctttttaaaggatgcactaaattcaattttttaatattaagcagtatatgtaaagagtaagcatacacagaaagaataaaaatacaacatactatcatcgagtgctattagtaaaatttcacattacaataaaattgtatcttaataatttaaaacaattcaattaattgatttaacagttcactaaattataattatttaagtacgtacttgtaagatacattgttaacaaatttaaaaatacacatattcttccagaattggtgaatgaaccaaacatttgatatgtacctcgatgaataagcatttcaatgaaaaacatgaacaaagtttaagtggttaataacaaactttaagtatattttattcattgtgcattttagcttccaaattcttcaattttttaacatctaagaagctcacaatttgccattttaataagatctgtataaatgcatttaatatgcaaaatctgacatgtcagtcctaattaatgtaaacaaagactcgcaatgaatgaatttaattacttcgaaactagtatgtctaactaagatgaaaagcaaacgagtgcaatctaatctcagcaaagaatatttatgattataagctttgtcaatagcaaagtgcaccaactgttcatatatctgacttccaagagatacatgaatgctaatcagttcattagaggcttctaggttgtgatatttaatgacaggatgtagtagctttcttgtccatggagtataattgtactcagaatgaaaaattgtttccaacaaagcatcatccttcctgtttctgatttcctgctggttgctttttatgagccgcatacctttcaagaagccgacatcattcagtttcttgtgtcatataaatccaagtatagatatgtcctgagatcgtgtgctaagcaagattctacaacctttactccaagctcaggaattcatcttggttctataaacctgagcttcataattagtgcattcacagtgtactaccagaagctacatgcaagcaaaatcttttctgaactgctttatatctatagggaacaataataagtagttcaattaacagtacttagttattaacaaactgtcacatatgaatattttaacatgataaaattaagaaaaaagctaagaatgatgaaacatataactgcaataatatatttattttagaaagcacactttgtcatatgagaaggtagtacaaaaaaatttttgatgaatacagatttcacctttacttaaaaagaaaaaaaaaaaaaaagccttactcagtagggtgataaaggcatcctccctaatgaaataagaaactggatgggtggcaagatacaaaaggaaacaaacacgttagcctgaattgattgttgctggagtatatttttatgatatttcccgacagagacagtgaaggaagctaaaactcaactagttcacaattaagctgaaagcatatacaataaaatctatgacaagccaaatattaattttgtgattcactaaatctcaggagagaagaggtagaaagaggaaaaatagtcattttatttcaagtacctcagtttaagatattaggagtgtctatttataagagctcattttagaagtgagttatctttcatacagaattcatttgtccatatgggattttaataatgcattgtagtaatattttattacaacacaaaagatatcagtctgtaatttcataaaatggtttgcaaagcaactcaacattactttcaggaaataaaagtttattacttcagttactcattagagattaagctacaaagttagtgataataaagataattgaatacaaaagaaaccttaaacaggacacaagcctcatgctattaattatatatgtgtgtgtgtgtgtgtgtgtatgtatatacacacatacataccgatttatttgggttaggaaaatatcaatacaagtagtgactataataaactccattttgattttataaccatctagtatttctaaaggaaatattaaattttatggagcacaaactaatttataatatatgccaattcttgaagttaagctgactagttaaacacgtttatgaagtcttgtatctgcttcctcagacatttcaaaggtatctaaatcacatcatgagtttagagtcaaacttcctcaacctgagttttaatatcctttcaattcatcatgtacatcagaaggaaataaggtatatgacagggaaaagatgagagaacatactattatctaagctgataaaaaggaaaaaaatagaaattaatgatcatacatttgtgggtgggcgtggtggctcacgcctataatcccagcactttgggaggctgaggctggcagatcacttgaggtcaggaggtcgataccagtctggcgaatatggtgaaaccctgtctctactaaaaatacaaaaaaattagctgggcatggtggtgcgtgcctgtaggcccagctacttgagagactgaggcaggagaattgcttgaacttgggaagcagaggttgcagtgagccaagatcatgccaccgcactccagcctgggtttcaaaaaataaataaataaataaataaacaaacagacagacagacagacatttgtgtattattcatgattgacagacactttgataaatttccctgcaagaaggcaaaggttaaactttctgtaatttggcactacagaatgatctctggttacacaaagacatctaaaatattaaataaattgtatctctagttgactagtgacttaagttatttagctatcaaaaggatatggacatctttgtcacaaacttgtcatgcaagtcctcaggagggggaaaggtttccaattccttctcaagctgttgaagctgccttcccatctgcctcaaattcttttccagcgtttctacagagactaaaagagagtatattaaatgcccggaaaggacaaaattataatatataaaaggtaagacaccctagaaacaaaacattcatgaaaacaactcacaataatgtaagaaaattcattataaaataaaaataaatttcacttttaacctttcaatttaaaatctagttataaaagaaattcagtaagacagtctttaaaacgtaagacaaaatttaagaaatgctcacacacacaaataaaccacacttcagaaataagtttcattagaattcttgaccattggaaatactacaaaatcatcagtctattcagagacaaaaagaaaacattttttaaaattggactgatttaaatataatttgaacatttttcaaaatcatctcttgacagggaacagtgagtagatgggaaagatggggaaaagtgttttttattgtccaagcttatctacaatgggaaagaaaaggtatcagaggctacttataatgacaaatgtcaagctttctttgctgatatcctgaacacaatttgtgtttattatctaataatatttttccttctttgacttaaagtggctctcacggtacacatgaagaagaaatggtaaaccagggcactgtgtcactatgagaatatactagccacccagcagaacagacattaaggatcatttctgaaaatcttttcatagtcaattttatatgacaccaggaaaaagatttaatagtgcaaaaagaagatagagtgacctaaaccaacttttaaaatatttgctttaggtacaaatgaattctaggttaaaaaaaaatctattgtttttgttcaatgtgaactatataaaatgatgtttaaagaatgaatacagtaattcaaggtaatctgccattcttaggatttgaattaatcctgaaggatttgaattaatcctgaagaatgggtgcaattcaagttttatctataaggataggaatatccttggaagcaatctaaatgcccaacaaaatgaaactgagttgttttttttttaattttagcttggttcaaaagaataaaatagtaaggagacattaaaaataatgtgtaagaatatgaaatggtgttttattgtttttttaacctggttgtacagaaaataacatttggtattctgacattaacagcttttaataaaacctaaatgtattttcttattttaaaaaattagcaatctaattctcagatgcaacgtttaaggagtccaatgattgaactcttccgagaaccacatataatacttgtttgtgcttgaagagtgatggtactttaactgtttgctcccactatgatgaagctagtctggatttacactcatgcatattttctcagtaggttttttttttccttctcacgtattccctttctgtgatactttgaatttacacactaaatgctataataatacacactattatctgagtcattgtctcaaatttaagaatcacatattcttacctttttaactatttaaattattccaataccttgctgtgcattgctcatagtggtaacatatatttcctatgttatactctttcatttttatgtctgcttgtcaattatccacaaccaagattctatttgattaggccaatggtgtttcatttactcttcccgtttccaacttttttctttgcttctttcaaagttctctatctgcattacataagagattccttttgctctcctagtctatttgatctctcccttaaagtctcattagcatttcctctatcatttttcaagaactcttacaggtggttcagtcactttttatacttcctaaaactctgcaacttctgactaaataaaggttcaaaagcaagctgggcatggtgatgcacatctgtaatcctagcactttaggagctgaggtaggaggatcaacttgaagccaggagttcaagaccagcctggacaacaacaagactctgtgcctccaaaaattaaaaaaaaaaaattagccagccatggtggcatgtgcctgtagtcccagctaatatggaggctgaggtgggaaaattgcttgatcccagaagtttgaagctacagtgaccagtcatggcaccaatgcaccacagcctgagtgacagagcaagaccctgtctcttttattaagtaaatacatgctcagaaatgtttataagccatacatctactttgtgctataaattaggttcaaaaaagtagtgtattagtagtataatggtagcagtaattgttatattagtagcagtgacaataaaaataatagtaatggtaataacaacatctaaaatgtggtaagtgtttatgtatgtcaggtaccgtcttaagtgttttctattaattaactcatgcaatcctcaccagaacatcatgaagtaggcattattattattcctattttacagatgaggaaactggagctcagtaggtaagtaaaaaggtcaaattaaaaattggtgaagctagaatttgaattcaagcagtttcattccagaccttatttttaaccactgtgttatatataaattattatagaaattaccattttgttttcataacccctgtcagtaacatttaaataaacagatataattttcacataataaggggtttcttgtacattcttgcccattgcaatcacaagcaatccatattccctgcctaaacccagggaatatatgcctaagcattctggatggacgggtgagtgtgcagttatatatatataactttttatatatgtatttatttttaagtactatatatattaaagtggtatctcaccttgaacaaaaccacatacttaaaatacttagtctgctcaaccaattttattatgcacacatgtcaaattagcaaaagatctagagaacagaccaataggtctgagggactcccatatgagaaaaagcacagggcaaatgttgggagggaacatagattgtttgattttttctctgacaccaaatacattgttccaacaccaatcaattgtctaattctccaataccaactgggtgtcctacaattggagttagtgcagactccataagttaaggagaaaatccttcaattccgatactaactacccagatttagtgtcaggctgtacaggtagaagggctcactcccacaaaactaccctcatttcagatgccagttgccagtctagaggaccactctagactgactcgctataaatctggggattcccaaaactcccttccctgaagttccacaattcactagaatgactcacagaaatcaggaaagcactatacttatgattgtagctttattatgaaggacacaacccatgaacaaccaaacggaagagaggtacaggacaaggaatggtgggacgggggtggtgcacagtttcactgcccttccagcacttccaccctccaagcacatccatgtgttaccaacccagaagctcccccaacctctttcagtctttattgaagcctcattacaaaggcactattgattaaatcactggcatttgtgattgagctcaatcttcagcccctctcgcacccatacattgggtataagcccacagttctaaccctttaatcgtatgtttactacttctagaaaccagtcttcatcctgaagctatacccctacctgtctttagtcactacattaacatacaaaatatgtgtcactcaggaaattccaaaacttctaggagcttcgtgtcaggaaccagggggcaaagaccaaatatttacttttcattgtaccgtatggatatagaagtacatgtctggtcagagggcagaattccagtagggaggtgtaagagaagcacatttttggctcattctcagaggtgcctaaagtctaggctgccctcagaggaagccagctactggtaactgaagatagagctaccccaatgagtgagtgcttctcagctaggtgggagagggacttagtccactggataaaaggcctgtgacttttccaattctgtggttgtcagtgggtcaggaactatgctctttatgattggaagcaatttctcctgggcttgatttccacattagtgaaatgagaaggatctcaccgcgtatttttacctcacagacatttcataaagagtaagcaagctatcttcaaaaaaataaaatggttcttgaggctactctacagatgcaaatctcactaagccatttcttgtgcttcaccagaagtctctgattatttgcacattatttgcacattatggttaagcagatttaaatgtaattgaccaacctctcacttggtttttaaataaggaccaacacacacttggaagaaagaaagcagcgtgagaattctgggctaagaaaatgtatgccatctgatgggtaaaactaaagagcattttaagaattcccttgctgtatttataagtcggatctgaataatgggaacacatggacacagggaggggaacaacacacagtggagcctgtatgagtggcgggcaggaggagggagagaatcaggaaaaatagctaatgcatggcaggcttaatacctaggtaatgggtttatagatgcagcaaaccaccatggcatacgtttacctatgtaacaaacctgcacatcctacacatatatcccagaacttaaaaaaaaaaaaaaagaattcccttggtgtttttattttttcagcaattattctatttctatagacaattcttgtatgtatcttcaaacataattttagccacatttttcacatgtatcaggttctttgaggtcaggaactatattttatgtcttaaaaatcttaactatatccagatcacgaggtcaggacatcgagaccatcctagctaacacggggaaaccccgtctctactaaaaatataaaaaattagccaggcgtggtggcgagcgcctgtagtcccacctactcaggaggttgaggcaggagaatggcatgaacccgggaggcaaagcttgcagtgagctgagatcgcgccactgcactccagcctgggtgacggagcgagactccatcccaaaaaaaaaaaaaaggaaaaaacaaaacaaaacaaaaactatatcagggagtattaaattgtacactcttaaagaatttttaatttactggtgtctctgtatgtgacctatgtgtgaattttatctttcaatcttctcaccaagaaattaatcatattttttgtattcctgttcattctttggaagaaaactaacaaaacagagccatcatcaaacagagctagctagacaattttgacttttgcattttcctcagttaacattccaccagatgacatctctcagtcacttcagacatcatgtgtctctatctccaacctgctccctatgtgtaatctccataccacagaaggcaaaaggaccataaatcccatttcttgtgctagaaacctgctggtcttgaccctttcctctcttgcaattctcagattcaaacaatcatgacactcaggcattttacttgacaaatagtacttaattccttcctgacttaacacctttttttctttctctttttttttgagacaccatttttttcctttttccttttttttctttttgagatggagtctcactctgttgcccaggctggagtgcactggtgtgatctcggctcactgcaaactccgcctcctgggttcaagcaattctcctgcctcagtctcctgagtagctaggattataggcataaaccaccacctggcttatttttgtatttttagtagagacggggtttcaccatgttagtcaggctggtcttgaactcctgacctcatgatctgcctgccttggactcccaaagtgttggaattacaggtgtgagccaccgcgcctggctgacttaacacttttaaagtcatagggaacccttttgtcttctctgatctctggtctcctacagtttttctccagcgtcattttcacactgtgcataggggtttccagacaatcagtaaagctgcccctttcctgttcaatgcatgtcagtaaactggttacataacatctgagttcctaaacaaagccccacctacaacctggggtgctctacttcatatcctgccaaatattcatctccaaaatacatactgcttatagttcccctgcccatatccctcttcatctaatctgtacctgatcctggaaataatgtgtgtctatctgccttgtgcacttcacccctgggtcataaccattcataatttacaaggaatcaaaaactacagcaagtacacaggtaaagtgccctttctcccaatcacaactagtaattatctctatctttgcaattactactctctatttacatttatctttttatctgtcttcctctcccaaatggctgggaattccttaagataagacaccattcatctttgtattttcgttacaaaacatattgcagatacccaaatgtttgctgaaggaatgggttttggatttaactttaacctcgccagataagagcgttaaaaatgaaacaggaaaatataacagattaaatatcccagacattaaaatcaaagacacaggctttcctccaagtgtcttattattatgataattatacaccagaggtgttaaagaagctttagagtaaaagttaaaatcgaaactataaatatttaagtttaaagcagtcatgaatacatgctttttataacaccatggcctctatgatttactagattaagatttcaagtaagaaaggagaggttacataatctttgtaattaaaaaaaaaaatcctctatgaatatctcctggaggtgttggtcattatttcataataagcttactaaaaaatgccacactcactcttacacatcatgatacaatccagggaaattgatttctttaaggaaagcttaaagaacaacttattaccatagacaatttaaacatgcaaactaaatcaaaccttcctacactcatagaatcaattgtttcatgtgcaaaattatttagtttcaggctccaagcaatatatttcttcctagacaactgtaataataaaagcattttataaagctatagcaacattttataaatgcaagttaaaataataaaattgtatggacaaggtggtccaaaacaaacctcagtagtataaaaaaaaatcttgactattaagtaggtctacaacaaaacctaaattctagaataccattataaaatccattacatgacaaaaagatacaaaactaaaacaatactgaaaaaaaatcaaagtaaaaataaattgtagcttagttcgtaacaggcaaagataaattgaaagaaactgtgctgccgggtgcagtggttcactcctgtaatctcagcactttgggaggctgaggtgagaggatcacttgaggccaggggtttgagaccagactgggcaacacagtgaaaccccatctctataaatttttttaaaaagattagccaggggtagtggtgcctgcctatactcctagttacccaggaggctgaggcaggaagatagcttgagcccaggaatttgaagttacagtaagcaatgattgcatcactgcactccaacctgggcgacagagggagatcttgtctcaaaaaaaagaaagacaaaggagcaatgctaagtgaacagccagtcatcctcatcaagtagttgtaccttccttgacttacctgactcagatcttctttcttcccattgttctgattcttgatggaaccccaggtaataacaaatggaatttgcattccttaattaatttactatactgtatgcaatgatggtttaatttttgttgtttttacataatactgcaagagaaatgccttcatctgctatggaacatggaaagaagaaagggagaaggcaagtagaggaaatgaatacaaccaattaaaggcccccagtcaattctgttgagctatttcatcccctgaaagaaagagccagccctgtcctttacaagtacaaagagggtattaaaggcggcagccttttagaagagaaagtgtattagtgggagaagcccatctcaaaggaaatcatgtttacctataagatttcagaattcccttagataagatgttcaaaaccatggtataaatattacataagaggtgcataacagaaatgtttaataacaatattcaaaatgttcccttagtataatggttctgtgtacatgtacatgggagggcaattttactgctttttactttgtcacaggggaaatgttaagcacagactgactgactttcaagtaagactagttttcacttgctgctattggagaccaggtcagcctcacaattccaagattgtgtattagctggacttcaaaaaagtccaaattttttctcaagcctagatccttcccctgaactccaatggcctatttggacatgtttccttaatatttagctggcaccttaaactcacttttccaattagaatttatcttcctccttgacttgcccctacatcgcagtaaatcattagtttttataactcttttctctttcatgccgcacacatctaaccatagagcgcatcttgctggttctaacctcaaaatgcattcgttttccaaatacttcttaccaccctcactactcttcccgatccaagccaacattattcctcctctagattattttaacagcatcagagtggttttactcattctaccattattcatctacactttttcctcaacagagcagccaaagcaatcctttgaaaatttaagtcagatgtcactcttttgctcaaaaccttccgtggcttttgagtggctcctcatctcagagtaaagtcaaatctttttttttttttttttaattattatactttaagttttagggtacatgtgcacattgtgcaggttagttacatatgcatacatgtgccatgctggtgcgctgcacccactaactcgtcatctagccttaggtatatctcccagtgctatccctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattatgtgaagaaagtcattggtagcttgatggggatggcattgaatctgtaaattaccttgggcagtatggccattttcacgatattgagtcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttattgatttttgtacattgattttgtatcctgagactttgctgaagttgcttctcagcttaaggagattttgggctgagacgatggggttttctagataaacaatcatgtcgtctgcaaacagggacaatttgacttcctcttttcctaattgaataccctttatttccttctcctgcctgattggcctggccagaacttccaacactatgttgaataggagcggtgagagagggcatccctgtcttgtgccagttttcaaagggaatgcttccagtttttgcccattcagtatgatattggctgtgggtctgtcatagacagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagtagcacatcaaaaagcttatccaccatgatcaagtcaaatctttacaatggacagtaatgccctacaggatctattacctttctgaccttatctcctattatgctccccctctctccctctgctccagtctcacttccataccttgaggcctttacacttgcttttccctttgcctggaatagtcttctctcaaataccaacataaatggcctctctacgactcttttatgtttttctcaaagaccactttctctacaggaccttttctgaccactcaatctaaaactgcaaaaaaccctgccctggcatgccagagtcagacataagacatacattgacttctttcattggcttggttctatatctgccacctaaaatgtaaacttcaagaaagcagaggcttttgtttttacagctctttggtgccttggaatggatgaggtattcagtaaatgactgattcaacaatgaatagatgaatcttttttttttttttttttttttgagacagcgtttcgctctttgcccaggttggagcgcaatggcgcaacctccgcctcccgggtccaagtgattctcctatctcagcctccccagtagctgatattacacacatgcaccaccacgcccagttttttgtatttttagtagagacggggtttcaccatgttggccaggatggtctcaatctcttgacctcatgatccgcacgcctcggcctcccaaagtgctgggattacaggcgtgagccatggcgcccagccaaatagatgaatcttatttaaactaactttatttttttttttctgtcactcacagtcaagcctaatccttgctaatacaagtgcctagcacaatgcctaccaaacaggagttcaataagctgttttgagagtcctttccttatagagtcaaaacatatcaaaaactactaattaacactagctcttttttccataaaatatggtttgaaagatagctgccaagaagccaccatcacagtggtagacacttatatgacaaaagggtctcactgctgatcaattttaaatctatacttaaaggtgatctcttctgaggggagaaaggacgattacccaatatcttattttctttaggttttcctatgagcgtgaataaatattattttagattttcctagcacttatatcatttctcataaagtagttcatatttccatatggcattccttcataattcttggctgaaatgaaaaaatttcttttttaaattcatgcatcacctccagaaaaataaactcagagttgaagagttgctggagaccagttgttttcaaaggttgtttagtactagaactccgttttcaaaagaaatcttatgtcaaagttcaaaatacaaaataacgtgttgcaggctgaagcagaggcagaaaaatagaactcattttccaaattccattccctatgttagtatgtccaactcgtaaaaatgcattgagctgtacacttatgatcctgtacacttatgtaactgcatgtgtattattctttaatttttagaaaagtaccaacatttttagaaaactactaacataagcctacaaaatttgcagtcgttatgttctaaagtttgaataagcttcaggcaacacacagttggaatctgttcaaatttctgacaatacatattaaaattctatactaacacattattcacatagactcatgtttacctgcactgttaatgacaggcagatgtgtgccaacaataaataatcacggaaaaataacacccacactataagaaacatggagaatatttatataatgattaataggtacttttcaaacttgataaacatttgtacatattaacctatttaatcctcacaacaaacatctgggttaagtactaatattgcacccattttataggtaggaaaagggaagctcagacagaataagaaacttgtctaagattatacctataacaagctggggtttcaactccaggtgaaccagttacctaacctcagagtccatggtccagataacagtttctcctatcatataatgtttctataatctaattgcaaacacatttttaattttgcccactaaaatcacttattacagttattgctgttatcatggcctatcaataaaaaaattccttaaattcacaggctgatatggtttggatttgtgtcccctcccaaatctcacgttgaattgtgatccccagtgttaaagaagggcactgataggaggtgattggatcatggtggtgagttttcctcttgctgttctcatgatagtgagtgagttttcacgagatctggttgtttaaaagtgtgcagcacctctccctgcactctcttcctccttctccagccatgtaagatgtgcgtgctgctcctttgccgtctgccatgattgtaagttttctgagtcctccccagccattcttcctgtatagcctgtgtaactgcgagccacttaaaccacttttctttataaattactcggtctcaggtagctctttgtaactatgcaaaaacggactaatacaaaggcatacaataatttcagttttaactggtttagtattttcacacaatgacaaagaaaagggtatttctgaagcatattaacaataactttaaaaaccaaactatttcacaatttaatgatacatgctttccagatatgcttattagtataatttccatgcactgtttcataatactcaaagatgacagtgctatctccatgcagttataggacttatgccaaagatgactgtagtgggtgagtagtgccccccaaaaatgcatatccacccagaacctcagaatgtgacttatttggaaataggaactttgcagatgaaattagttaaggatcttgagatgaaatcatcctgtgactgacatcatccaatgactagtgtccataagcagaggtgaggaccccgagagacatggagaagatggtgagaagatgcaggcagagagtggagtgatgcatctacaagccaaggaacacgaaggactctgagtagccactagaagctggaagagaagcatggatgcttcctcccctggagtcttctgaagatgccaaccctactaatactatgatttcagagactttagtgagagacttaatttctgttgtttacaggcactcagtttgtggtaattggttatggcagccctaacaaaccaatacaactactaattcaagattctgtaagatgcataaatacattctggtttctggagagcagctgacaattctacctgcagcatttgattatctccatacctcttcccccaattggttacatgtcaaccttgtctccaacaagattcataagattgccattaatgtgtttgctctatctactgcttaggtttctttgtagtacacagatttgttatgttaaactgtccttcagaatatactattctgaaattttctttcacctacttcatattgcaaaactaaggtgcagtaaatattgctttacagccacaagtgtaagagagttctaaaaccttggtcatcactggtgatactgtcctgttacttgatgttcgctatagttcataggtgacactgacagaactgctcaagtagctacttcaaatccgtagctggcccaaaatctgcaaacactgtaaactgttagtttctcgaaaagattaatgatgtattgatgacactttcagcctgttaacctccaaaaagatatagaggtcttcctgatgtggttttcttcttcatcatcatctattagcccaagccacagcagattcaggaaatgttcctagctcagtatctcaaaaagcaatctttagctgcaagtagttcctctgtgcccagtgttctttaatgtcaatctacagaatccttaatccttctagtgatttttgggacattctctttctattccactctgctgctttccaacacagtttatatttgcactgcaaaatgattactcttacaatctcatatccaagtctacaacttaaacttttcatgccaactctatacagataatccctggaaataaactggcaggatttaaatatgtggtctcttaccactataccacacttgcaatacactacaaatatttttcacaaatcctgtaattaccttgggaatggcccagttatatctcatcatacctttttgtgaaaaaagtattaatttattgaacataaaattgtacatattctaacattttggtaagtatatgcaaacatatataaattatattttaaaaataaatttaacttttattatatttggcttatattaacattaaaattattttagaattcctaagtatacttactaaatataaatgtaaagtatactaatgtatgctttagaattcctaagtaaattcctaagtatacttactagatgactgcagatagtcaaattagttccctgagacataaaaccattaggagtcataagctggctttacgaacataggttttactccacagtctatctgtagaaccagcactacacaacttggatatactaaatactttcattattcccacaggaaaatgaaaaaaaaaaagtaacatcatccacctatgccttacttttggaaaggtgtcaagagataactcagagtgttactaatgtttatcagttacctgcttatatgaaaattacaactattatagtagcaaaacagggagaaatggaaaagaaacatatatatatttatggatatatatatatatggatatagtgagtaaaagaaaaagacaaaacaaaaacttggtatagtatgattaactgtattctaaaacaaaatctaggaaatgccgtagatctaatcctgaaattaaatgagaattttcatgaatatatttatttaaaatgccttaatatatccttatacatgtactactttatgtttcatgtctactcaaaagaggaattgaagcatacttgcaattatttcaaaacatctgataattcagtttgtagaagaatctttgatatttctaaattgattactagtgcacatccaacacagcagctctacaactgctacttcaactgatttgataaagtgaaaaaccattcagtataggctactgtattctatagccaaagaccactaagcaaatgagaaaaatgtcttaagttagtatattagtttgctagggctgccttcataaaataccccaggctgagtggcttaaacaacagaaattcatttcctcaattctggaggccagaagtccaagatcaaggtgttggcagagttggtttcctctgaggggcataaggaaatgatttgctccaggcccctccccatggcttgcagatggccacctcctcactgtgtcttcacatggtctatcctctgtacatgtacattcctgaatggctgtgactctaaatttcctcttcttataaggacacaggtcagattggattagggatatcctaatgatctcattttaactctcctctctttaaaggccctatctccaaacatagtcaagttctgacatactgaggtttagggctttaacataggaatttatgagggaacagtacagcttgtaacagttagaaaacatttttgttcccttgaccagtcaataaaagcaacatcccacatggttgtcttctataactaaattattttatcataaatatttccaccaccaacaatgtaacctattaactacatcatataggcagatattggtaaaaaaaaaaaaaaagtgtcttttcataacattctaatattctactcctgatttgaaagaccaaataatatatcgtacacaaattatgaggccccaacctacaacctccacgacataatgattccaaccaatataatgttagctgtgttgttgactctgctgcaggggatataaaatgcaattaaactaataactaatactgattattcaaaatatgtatcaaactcactaacaaattgtaactggcatttttagaaggctatagcaacaaagaggttaacgtgtcttttggttatagcagataaatttgaaattttcaaacactataaattttccaggtggttgccacctggaaattaagtgttctaagtgctcacagtaggtgaataaaagataaacatttggtatttagtaagacatttatcataaaatgatggaaacgcatgagaaactggaaaccaggagacgtatttgagcagacaaatattagggtcaaatcaaggaattgctagctaaaaacatataaacagagtcttagaagcagaaagcatagtattaaatggaaaggatttaaaaatcaaatatatcagtgaatgctcttaatggtaaaatatggaaacagagaaatatggcaaaaattaaaaatgagttaacattgaatccactctgataatacactgaatattgatctcttctagaagcttaaatctattcacagctgtcccaggaataatccctggtctagagcagcagttcctaaagtataagaattcctggaaaacgtatgaatttatccttaaataaagagtagaatacacaaatttaggtgaggttcccagcaaaaagcaccaaagggaaggtgacatttacttttaagtttcttgatgaaggagaaaactagacaacattcttgccacagctgccacttcccatggatttaacttaggcaaaagccaccatgcagctctgcattgagatgctgaaggctatatagagatatgacaaatgagagaaaagatatccaaagaaggggagccaagcaggattttttcaagtaaacaaaatttggaaggagaggttaagggtgtaggaatcaaaagtcccattttgtggcataatatgattctgacacctttttgagatgctatggaaatagcaaaagctgttgtctatagaagtgtggatcttagaaggaaagtctgggatataaatttgtaagtctttaacataatggtggtattatgggaattgaaaacatcacctaaagagaagatctagggagaaaagaagagaagggttcaccattaggctagtgaaaagcacttttaaaaaagcaatgcatagacactgcacagaggaagaggagaaagtaaaggaaattgaccataggagggaagagccagctggggaagagctagatgggagtgagacagattgggtttcactaagacacagacactacacctgaaccaagagtaagacaagagcacagtttctgacacagtgtaatcactcaataaaggcttgttaagttagtgattggatgaatgagttacagactgaactagcacggtatttctagaattaagagttgactaggaaaggatggaaatacatggtggaattataactctaaaaaggtcagaccaaggtgatgttgtaaacttaccttagttttattttaatatactcaccaacaaaaaaaagtaagttttgtcatattttttactctttaataaaatttaataatgaaatagattattgggaagtaatcaataaaacctttatagattaattttaactgcttagacaaggaaaaatgtattgaaccttagaagtccaaaaagagagaaatattacaatggtatacagaaatacaataatgactaaaaatatttccactgaaatgcaacagaaaagttgtaagccattatatcttagaaaagaagcagtcctaatgaagtagatttttgaaaattgtcatacaggtaagctcattagttgcaatgaaagttctccctgctgatctaggagtacttaatgaccaggatttgttatgcctcaaaaacaaaggtactttttaattcatgtgatagctcactgaggaggtttcaaatctggaaacttttaaatgatgatatataacacgtgtataagagcattaaaatactccaaagcaaacacacttacctcattcaaaatattacattttctcctcaaatctcattaataaagtaatataataataaaaaagttatgcttaacaatcacctatactataaaaagtacttcagtgatggcttttctatgttaaagatgaagttggctgctccctgtgaaacatactaacggtgtctgctgacccatacacagacactagactccactcttaacagatggaaactaaaaagtcccaaaaccccagaacgccctgctgaaacacaaaaacaacaaaaagaaaaatacccagaagaaccaaaccaagttacagttctgcaagtccttatcaaaggtaaatatttttaaagaacaaattataatatcaataaagaattttaagtatgagtcaacataaatatttcaaaaacttcatttacagcaaaacctgctaaacaataaattctacaataaaaaatacatctactcaaccatgtttttccccaggaaaaaaactcccggtgtatttcaaggcactttgtacctaccatgttttcatccactactccgttatctatcaaactgattaatgtccatcaagaatactcatttccaatttttttttatcccatttggtcaaaaaatccaaaatatcagaattctctctttaggagagttgatttccctgaggtaaaagttattttgaatatcactgagtgattctgaatgtttacaacccattcagttcaatgcccttttgccctatctcaggtgatttaacacaagaaaataatttcaattattttcccttcttgaatcctattaaaacatctataactatatatatgggaagattcttcttatagcaaggacattttcaggttgcagaggggtaaagtgagtaattcaataattcattggaacactaggatttattagtgaaaatttaagtaaaaggcttattttttgtcttacaaatcaagacaggccatatgaaatatttacttcaaggaaacatacatctcagaacaaagtttcaaagaacatctcatccaatcacatgcttctttgtcaataaagttctataatcctcattttatagaagaagaacaatttaaagggagcaggaaaagataaaattaattttttttaaagaagaaatattcactctaatatggaaaacaataaaatatccttcaagttgatgaattccaatattaaaaagaaaataaagaggttataaagacaatttcatattactaatgactagtagtcaacaaaaaaagaatacagatattccagcattccagatgagttgttttccaaaatgtattcataaattggttgtttgacaccaagtaaagttgaaagaatcaatgtgaaatataaatgaaaattgaggccgggcgcggtggctcatgcctgtaatcccagcactttgggaggctgaggcaggcggatcaggaggtcaggagatcgagactatcctggctaacatggtgaaaccccgtctctactaaaaatataataaattatccaggcatggaggcgggtgcctgtagtcccagctactcaggaggctgaggcaggagaatggcatgaacctgggaggcggagcttgcagtgagccaagatcacgccactgcactccagcctgggcaacagagcgagactccatctcaaaaaaaggaaaaaaaagaaaaagaaaaagaaaattgaattattaaggtagtcaaaaaattatatttaaatcatattataaccaagtattaataatagctctatccgttctatgaccctttatgacctgatctaagcccacaattgagactagaatcaggttagaaatttgggcattaggaaagagtgaaatgaaactctggcagtatggtgtcttctataacaaaaaaagagagcaccaacaagttgggcagagatagatttggtactcaggtaagtagggagggacactgattgctggttctggtatcaggtatgtaataggctatcagtgcctatgaatgacattgaatcaagagagcatcaccctggccaaaaagtgcaggagatttagcagtagaaggtagggctagcaggtatctacaaggtttaaactgtaaaacaaagtattttataatataaggcctcatcatctaactaaacaaattaaactcatagctccaatcatgacaactcataatatcctacaactctctttatttttaaaatgagatattgggtatgaaaacactgtgagaaagtggaaagtacatacaaataaaaggtataattttcagtcttttagcactgaagatcagagccatgaaatgtttcttaaaaaggcacaaacctttactagctttgtctaaaggttccaaatcatccacaaaattcagtatatcagggtacttctcttcacatatttctaccaggaaatgaagtagcgttgttttctgatctgctgattttgtgtcctttagctaaatagaacaggagggagaaaaaacacagagtcataagtatgttgatattctgtctacttaaataatattaatactgtattttgtagataaggactaaaagttgtaaaattagttgatttcgtttttgaaaaacaaatatttaaatactcgaaaaactacttttgacttgctgcttggtgaaaatcattatttgtcgcaaaaaaggaataagtttaatcgagcatgcaatgttttatagaaaaaaatatggaaaatgcctaggaaaacagagtaacctatgagtctatttaatagtagtatttaaacatccttggcattcatccatttatcacttggcacatatccatagaatgcctactagctactgtagtagttggagacctaacaacaaataaaacatagactttcctcaagaagctgtttagttaaaaaatatacgtatttgccttggtgtgacaaatagtatagtaaaaataatcacaactttcatttaggaggacatgacaatggaactgagacttcaaagacaggaagttgtatgggcttagggaaaagaaagaaaaaatacaaaagtgcattaacacaggctcatggagcagcatttacaagggctatagatgaggaaggatatgacacctctgaggcagctgagtgactccagaattaaagtgtatctgtattagggaaggcatgtagggacatggcaaagatataaatctgaaaagaccaaaaaataaaaggaaagataatggcatgcaatggaagtaggattttgattttgaagcaatataagttttccaactagatgagagatgatcagatatacattttagaaagctccctccagtgagtgtggctaaaaagattagggcaagagtactaagagaagcatgaagagtgagttaaaaacccatggcaataatcaggcagggaaagagggcagtctgaatggaggttgtgcctgggaaatggggacaatgagaccatgtgggtgtggaaacccaggtgatgctgttaactaccatgtcagaaatgatgagaaacagatttgtgtgaggtggccaaagaagaaaattgttttggacaaggtaaatttgaagcttttcagtagtacccaggtggaaatgtcttgaaagaatatacatttatctatctatgtatagaacagtgctttcattattttttttcatgattgccccctaagaagtttttaggcatttttttcctaactgcacctataaaattttaaaatcacaaaggtgatgcatttatgtttatatactgtatgcatatctgtgttttacacctaaaaactggttaaacaagtaagacatttttgctctccaagaaccaactttttatccctgaaagatacctattgaaaatacatggttaaacctcagaggaataaactggggcaccaacttgtgacccctttcctcccaaagctaattagttgatcaaattaacataaacaggtatgtagaatgaatgaaaagaggttacgggcttgagacgaccagggtggaccaatcctaatctgaaatggccaaggagtgcaatcacagggagaggtagttaagctaaaacttcaacaatgataaaagttagcttgggttttgtgtagtgttgggatagaaagtattggcaaggaggagtggtatgaacacaggactaataggtaatctggtagcattccctaccattaagtaatcatttagagcagagatacaaataaagggttaaaaaaaaaatcagtcttttctaccagaatttaatttacagctggaaattcaaggcatacctaattgggcacagtactacttacttgcttcctttccaagaatttccaactttaaaattggctcctaaataaattcccataagtaatattttaaaaaatccaacctcactaaatattctatcactatcagaaaaataccaaataactgttaaagtccagtagtggaagaatgggagatttccgtaccatcagacatattaacatactgactacttattgattcaaaaactatcatagagccgggaacagtgagctacccacctagacagctttactttcacatcatgacacatgtaataggttcaaatgctatgctgacctacacaacatgcaacttatacagtggttcccagtactttaaaaacagactgaatatgaacacttagtccatgatttggtaccttgtttaaaagaaatacagatttcacaacatagagctgagtgttttacaagaggatgcctcaaaaacatgactccattgactacctagacaaatagtcactaacatacgtggatgatttggcaatgttaaaacatgtccttgactaattaatagtcttgagcacattactggaccttagctttcacacaggtaaaataagaaaatgaaacaacatagaaactctaaattcactttttactctaaaaatgttaagtatacattatagtggaactaagagttagtagacacagtacaatttaatttttaaaaactggaagagtggagaaatgtagtaataatctcatttcagagttatttctgtgtgtttgggtcagttggaatcattctatgggcttctgtttttacatatagactcatgaatgtcaaatacaatctttaagtttcgttacaatcctataatttcattcatactatcatcttaaataggtaaggccagattaaaagcagcaaacttttacaaacagttttctctttgcacagccaccaaaagttaacatgaaagttgtattctgttttgttaaaaagcaccctagtagcaaagatcctttatctcacccaccctcatttacagcaatgactacttggggaacactgttcctactctgaattctcggcaacccatttttactagtctacacccttgtagactgtttggaacgttaagacaatcaccatctaccttcacaatttgtaaagcctagaaagagtattccaatagtatctgtgatatagctaaacagccagcaactgctaggattaacgtatcaagaaatctcaatgacggaagaacaaccaactggattgctcttggtctttatttgtaagcaatgagaattcagaatttagaatcatggaaaacaatgtagtttgtagcaacttagtttaataaatgttaaatactcaagtcaaacacagattcgagttattcagagaccattataaagctaaacactgatttaggaggagggtgctaccatgggttgtcttgttgaaaacatcaactgagtagcaagcagcataatgggaacaatctagtattaaaaagtacactcactgaatagtaaagggaagcacaatattcctatcatttcaaaatgggtatttaacaattgaaagacaccactcaaactttcatgtaaataaatttgaaactaagcctaataaataagaggttcagaaaagaagcatgttgttgatcatgcatggtgtctcatttataaactactatgcagctctaaactccagggcagagattcttcatttatgctctaacattctctagaaaaatttcacaatgctgccaagatactcttcctgcctcaactactctattctctccctcccctctctctaaccatcttttaaaaagtcttccaaaagcatcaaagcataaaatgtattaggtccttatccatttgctcaatatttttttcatttcattaatgaaaattaccaactaaaaaggcacattctactcctactcatatcatactcactcatatcataatcagtttctgagctagaacaagtaaagcttggaatacagtgttaattttgttgaagatgagtaacaacttatgtaaactttgtaacgctaaatcttggaaagaaaataaaatatttgctttaaaaatatcttcaggttaaaagtatgctttatttaaactttaacagtcagtgcttgacaggatttcttttgtattactgtcaagagatttatcttactgatgagtaatcatcaccgttaaacagaatttcctatttatgtattgtttctttaaggtacatttaacgtggcataaatgtcaaataaacaaaagatggatggagtttctccaaccactctgttcattccagacaaaataatgttaaaagtggatcctgtaataaatcatggcctagttgtcagtctgcagtaaaactcccttgcagttacagtgcaaggtttggggatatttttgaggtattcagcacaaatctggatgacatttaaagaatattccatttatttagtcacatggtaataatttaaatttaaaccctaaaataaaaactaagcatcttcgtgatcttcagaagtcaaggaactggaatcccttcctgtttgaaataatgaaacttacatcttaagaatattatcacattaataactctactccgcatcattatgttcctataatctaggtatgtatcaaagcagcattgaatatttagatgtttagatgctgtggacattagtgaacaccagaaacaagacaaaattctgaaaaatcttgtaatggcaccattaccattttagaagaatacaacctgtgaataatattaatgctgaggatgacagtagcatcctcagcattaatgtttggtacttaccatgagacagacattagccaaataatataacacatgttaagtgcttaaaacattacaaccccaaactagtattatatccattatttaaaaaggaaaatggaaatttagagagatcatatagcttacactggatcacatggagccaatgattggaacacatgtctgtgtgaatacaaagctcttatccactataaaatatagttcctttacagcaatctttagtctagcttattattaacaaaataaaccaaattctcaaaaaatggcagtaaaacaacaaaagagcactaatgcaatgtaaaatactagcaccctttaacctgttaattctagcctggaaagcatctaaaaacagacaccacactcccttgaggtcatttctagttctaagagcacaacattctattgttttatctgtaaaataaataaaatgccatctgaatcttatcaatcaaatagcaactctttatatatttctaatggattactgctgacaaaatatcatatgattgaagaaaaaggtatctataaagtttaaccttcaatggatttataccactatattttaatagcatcatatcccatctcaaatcttttgcagaataaagtggattgtgtatgcataaaatagcatccctaaaaataaaggtatctacgtgaaaatgaatgtatgaagacatactaacaaagactataacacaattgctcagacagaaagctcaaaaagtcaatgtggtagtacaaattcactaataaaaccaaccaccattatagaatggattttgttttctggtatgtacgtgtgcttgtgtgtgtgcctggtgtgtgtttgtgtgtgtatttgagatgggctcttgctttatttacatatatatttatttatttatatatataaatatttttaaatatatattttaaataatcattgtgctaacaaaatttttcaaaacaaaactgagtatcactccaatacaaatggcaatgaaaatcttgaagtaaataaaacaagatggttgaggcaggagaactgcatgagcctgggagttcaagactgcagtgagctatataatctctccactgcgctccggcatagatgacagagtgagacctggctcttaaaaaaaacaacaaaacaaaacaagcctaaggtgcttatgccactgccataaccacaaccattaatattaaaatataactttcttaataattctaaagatagaaaccaattgatattatataaattagatactaaggcatataaatactaaattacttatggcacccatatataaaaacaatttatattaattacttaatattcattttaaaatgataatgaaaattaaaacattaagtgaccaagaaagtgcattaaataatgtggacttccgtaattataatatgctaccatatccccacacactttctctgaattatatttttaacacatttctcttgaattacagtgagtgtagaaacttctatatagaaagcatttgtgcattttagtaaaagtttagcatactacattatctactgcgttgcactgttctgttcatactgccccctttttcctgcaaaagatataaaacagctcaatgttccttacaaaaaaggactattttcagttcttttagtactgagagatcagaaaacagacattcataacaggcaaatgggaaaaagtactagaataaacaatctgcaagggaacaaatatgattagaatacaaatatattttttaaatgctaaactcggatgatcaaagacataaaaaagatacaagatactgcttcagcaactatatcagcactctccacctaacaaaaacactctcaccaagaacaagaagtcatggcagggtcgcagtgagactggcactttcatagtgccagtctatgaaagccactgcaggcatgcgcaaatcagtaaaacctccaggaaaatgatttagtaacatacgtcaaaaattttaaaaatattcttgtttggagtagtttcagaaaactcactggagtccaacattgtccagccaaagctatgtaactaaactgctattttagagcacggatttcttaatctaataataagaatttctcatgggaacaattaacaaaaattggagtaagtgcttagaaagtgaacatgtttagattgtttatacaaatggaccaaatacattaattttaaaggttttttaacccttattaataattaactttatattttagactttatattttagagcaattttagctttacaggaaaaactaacagaaaacagagttcctgtatacccttccctacacacacacaaattatcctgttgtaaacattttacattagtgtggtacatttgtgacaagtaatgtaccagtattgacacgttattgttaactagtttccacgttaaggttctttctttgtgttctgcagttctatgtgtcttgataaactcagtgttattcatccatcactacaatgttatacagaatagttttaccaccctaaaaaattctgtgtctcacctattcattccttccttcttccctctcctcagaacccctggcaaccactgatgttttattgtctctagacttttgccacttacagaacatcacatagttggaatcatacagtagatagcccttccagtctggtttctatcacttagcaatacgaatttaatgttcttccatgtcttccattggcttaaagagatcatttatttttaatattgaataatattccaaatgaatataccacagtttatccattcacctattgaaggacatattgcttgcttccaagttcaggtaattattaataaaatggctgtaaacatttgtatgcaggtttttgtgtggacttaagttttcaattcatttgggtaaacacttaggagtgtgattactggatggtttgttctacgtgtagctttgtaattgccagttatccaaagttgatgtgccacattttgctttcccactagcaatgaatgaaggttgtactatatacttaccagcacttggtgctgtcagtgtttagtattttagcaatgccagtacatatgcagtggtgtcttattgtttgagtttgcaattccttaatgacatctgctgctgactattatagggacagaaaaattacaactccatcctcttagggtccttgctggtctgataatttaatttgacatgagagagattaacaggagaaacgtgtaatgcaagttttccgtagcacaaaggccatcaaaggaatgaagactgaaagaaatagagtcagttacccatataccggattgtgaaaagaacagttgttaaggagcaactacattaggtgggaaattacttttaacaaggcctctaaaaaattctctttgtttcgactttttgttgttgacgattaaggatgttgcatctttccagtacggaaaggccatcttttgcatgaaaatgttaacttctgcttttaagaaatagcaaggaggtcaaagcaatctttctacacctgctgtttttcaagtatctttaaatagtcaatataccagaatagcatattttaatcccttcaatatcttttcatacatttacctgacacctatacgttttgatgggtatctcttcacatcttttgatcatttctttaaactgggttgtttatttcttagttttaagagtttttgtacattttagataaaagtcctttatcaggtatgtgttttggaaagattttcttccagcctgttttcttttcattgtcttaactgtttgccacagaagttttaaattttaataaagttcaatttatcaattttctttcatagattatacttttagtgttatatctaaaacgtcataataaaaccaaaggtcacatagattttctcttatcttctataaaatgtatagtcttgcaatttatatttaggtccatgataaatttttagttaatttttgtgaaagatattaggtctggcaactttttttttttttaaatgtagatgttctcgtaccttttctttaaaagaaagactattctttcactattgaattacctttgttcctttgtcaaaatcaactgactatatttatacgaatctatttctggggtctctattccagtccattattttaaaattatttttattttttttccctttggccaataccacaatattttccttattgcagctttatactaagtctggaagtcagggagtgtcagatttccaacttagttcttcttcttcagtattgtgttagctattctgggtcttttgcctccccatacaaactttgaaatcattttgtcaatatccataaaataacttgctggaactctcactggggctctattgaacccatagatcaagttgggaagaaacgacaccttaatagtactgagacatgctttctatgaacatgaaatgtctattactttattagatcttctttgatttttttcaaagttttgtaggtgttttttttttttttttaaatttgagatggagtttcactcttgttgcttaggctagagtgcaatggcacgatctcggctcaccacaacctccgcttcccaggttcaagcgactctcctgtctcagcctccctagtagctgggattacaagcatgtgccaccacgcctggctaattttgtatttttagtagagacggggtttctccatgttggtcaagctggtcttgaactcccgacctcaggtgatctgcccgcctcagcctcccaaagtgcttggattacaggcatgagccaccacgcctggccttgtagttttcctcatacagatcttatatgtattttgttagattaatacctatgtatggtttttgttactaagaaaatgatacactattttaaatttccaattccaattgttcattgctggcatacaggaaaccactggctttttaaattaggtgacctcataatctaaaactttgatataattgcttaacagttccaggaggtttattttttgtccattttttttgggggggggggtggcgggcattctacacagacaatcatttcatctatgaagaaagagttttgtttattctgccccaatctttatagcttttatttttcttgtcttactgtactagccaggacttccaacacaatgttcaagaggagtagtgagagaagacacacctgcattgcttccagttttagggaaaaagcatcttgttccttaccattaagtatgatgctagctgtcgattttatgtagatgttctttatcaacttgaggaagttcccctctacccctatttggtgagaatttttctcattaatgaatgttacattttttcaaatgcattttctgcatctattggtgagttttcttctttagctcattgatgatgatagattacattaatggattttcaaatgtcgcacccagccaggatgcatagaattaaaaattattccctctccttctatttacttgaacagatttagagaattgaaattatttcttccttacatgtttgatagaatttactggtgaaaccatctgagccttgttctttctgtttttgaaggttattcattattgattcaagtattttaatagattcagattatccatttcctctagtgtgacttttggtagatggcatctatcaaggtccatttcatctaggttatcacatttgtaggcttggttgtgttaataatattcttccgttatctttttaacatccataggatcagtaacgatagtccctctttcgtttttgatatgggcaatttgtatcttctctctttttctcttggttagcttggctattgatctttttaaagactcaatcagatattggtgggtttgattttctctattaattttctgtatcaatttcattgatatctgctctagtatatattagttctttgtcttacctactccagagtccatttgctcttctttttcttgtttcctaaggttaaagattattctttttagatctttcttattttctaatataggcacttgatgctataaatttccctgtgagcactgcttttattgcatcgaacaaaactttataagttgtattttcattttgctgtttcatataagtggatcaaacagaataattttaaatgagatggttttgtttttttaaaaaaatacagaaacttctgaactttacattaaaggacttaacaaaacacacgcctggtatatctcaggtgatatttttcagtttgttctggtggtggtggattctgtacctcccaatgctggaaccatagttcaaagccacttatgacacatttcttcatcatcctctcccctgtcccccaagaacaaatgttcataagtaccaatggctaagtattactatgtggataataatgttgcatgttttgtctctgattccaaaaatgtagaaacaatgcagacccttgataaaggagaggtaagacacttcttagagtatcaggaatggagtgtcttgtttctggtttttatttttcatttataaaatatataaaagtgaagtctgaattaaaccagggatggtaatattcaccttcggtgctatctctgatggggtagttgtctataagcctgacgccgaggaggattcagaggctgggtgtttgggggaaagggtagtttgatagagaagctatgcttgctatgagagcaggaagatgaaggcacacaagcagcctatttgctgagcctgagcaaagtcactccatcttttataattctattagaagaatcattctcatttacaacatttaacagcaattgaataacaaaggtgacatgaaaataatttaccaaaaacgctatttagaaaagccaattaaatatttcttagaaaatgtcatagattaaatgtgttaatgaatgagtcaaagggggttaagcattctaaatagtttcacattgctttggaaatcagtatttctgtgatttaactggctgcatgtaaaataagaatggcatttgttatttgcaagtctttggcccataactgctttactttcaaaggttgccaaaatttactggtataattttgccaacctaataaagaataaaaatccctctcaaaataccctgaatgcaaatggaacaatggatttgttcggcagagatctttcttaaaaataaattcatagagtaaaggaaaaagtgatacatagggatcaaaacttcacaaaaacgactcacagtgttaacttgtgtgagtgtgacaggtatgcaaaatacaaactgcctgaaataggcaaaggtatcctgtctcatgcttttgtagtcactgaaactctacctgtacaagctagagacttgtaaaatggctcgagaaacaggccttcaacttatttcagttccactatgtgcctgaaattcacactccttttcaaagttttcattttcagagtaatgtttagcttggcatgagaggaaaagcagcaatttttgaaaatattttcaccactttttcttttttttttttttttttcactctttttacccaggctggagtgcagtggcatgatctcggctcactgcaacctccgcctcccgggttcaagcgattctcctgcctcagcctcacgaatagagtagctgggattacaggcgcctgccactatgcccagataagttttgtagttttagtagagacagggtttctctatgttggccaggctggtctcaaactcctgacctcaggtgataggcccgcctcagcctcgcaaagtgctgggattacaggcatgagccactgcgcctggcctcaccactcattcttaagtgaagaagtaaagttgtttcgtttttgtcgtggctttggtgttggttaattttcattttttcatgtttgcttttggttccagatcaccagtcagggattttccattctgggatatgaaagtagggcagaagaccaagcgattcacatttcaagttgagtatgaaaatcacctaggaagtagctttaaaaatgccaccaatcaggatccacatccattctttctaagttaattgaactggtgtggggactgcggcatcagtatttcttaaagggtactccaggttgctaatcaatgtcatccaaaagccatttgtcacaattttggaaagtgtctcattagggttggtggaaacattaaagaatatgagaatttaatgtttgttgctgtttctattgttttaattatctccatcacagctctgatgaagttattctactttttctactttttgcttataaaaggaatatccagaatcagataaaaaattcatgcattagaaaagagaatttaggaaaaattaattttgcctgccaccccctcaccgtcttagcacctactcctcaacgcccatagccccattaccatgtattcatcaatgacttcaactctgagacgaactcattagatattctactgccatagaaaacagaaggcttcctacaaagtgacagtatggataaatttaaagtgggatcaatagttatttgtttctgcaattttcccaaagaataacagcataaataccaataaaaattagttattacacgtggtaaaactccttcaaaacttatatctattaccccaatataggaagtcagttgattcaatcaatcacctggaacaaagagctgcatcatcctgttgtattgatcagaatgatctgttactcagaaattatacatcttattagacattagtaaacattattaaacacatgttatggttattatatgtggattagtaacatcttcttaaatttacaagtcaaaattatctcatatattttaatatggtgttgaactttgatggttgggtcaattcactctttacctaaaatcctttgaaaaaaatgaacttggccctatcaacgtgtctcttggagaaacatctttgatactaaccagatacaaacttttctaggtcagcattttggtcagataagcatctaccatctgccgatttaatttctaaagatatgttttccacttaatcaacagcagtctccccactctcaaaattaatatgatgtcaaaatgatatccattttttatctgaagttcagtactacatttggaggattttttaatgacaagcagtcctccattatttctgcaaggtttatccttttaaaaagtcaagccatcagaaagcaaggtacttacaccattttaactaaactagaagtagcattactgtgactgaaacgtacattttttttcacatcataagggttcgcatggggtgccaggtccttaagaggcccagaatacatattttgggggagaggggaagagaggaggagaaagagagattgttctaaaaaaaaaatcctgacgaaactgactcatttgttgtttataacactattcaacacgttttccttttgtaaagatacatatgcaaaatttcttatgaaggtttaatcagggaaaacactatttttgctcatgaagtgaagtttgcacatcactttgaccaccaaaaagtcaagcacctatatagcaactttaatttttatttagatcttaatcataaattcagttatgtttaccttatatgtcatattttacttttttgtcatatgtcacatgaaatctttgggatataagaaagcaaatccttttctctcgaatccagagatattatagttactcattgccatcctgactacaaatgtctacaaagctatgatacagctccccaaactaaactataatgggcatgaaactcaagtattcatgctcttatttctaaacaatgcaaagttaatttaatatgaattttcatgaatttttcatacttgagttaaattcgtaaagggcatttaaaagtaaggattttggatataaaatgttaaatgtcatataattacccagcatgttttaacagattaaaatacttccttgtctttctactgtcaaatatatatggaattccttgtgtagaagcttatcatcaaaccaaatgctttatactcagtgtgaaaattcaatcacaattgtcaaagatcaagctgctacttctgataacaaatatgatgagatatcatcttgttcaatatatgctttcaacttgacatgtaggctaataaaaaacatgaagttgtagtatttattttgtttcttccacaacagaaggctcctaagagggatgatcaaaatactcagtatcattgcaagaaaataaagtcaactctttatctgcagacagattaactggtttgccgactaactgtagtaaaagaataacagctacattgcatttgtaaaagatttaaaaattactatgcatcagtgattgtatctcaatgagaggatgtctatttattttcaacaacaaaataaacataagacactactttttgtcttatgacaagtttcattcattcaacagctatttattgagtacttactatataccaaccactgcagtaggctatcctacctcattaatcacacctagtctccctgtcaacagctctccttagaggaaggcataaggacatgaggaagagcatgcagccagtttttttgtgtcaactataattctgagatgtaaaacctaaagaggatcacagacacttttgcacgaggaaacagactgtagtacatgtgtggctgtggattaactttcccctatcttgcccctcaccctgtttttcttactttgccttccttctcagggaaagcctgaatctgccattcttgcttgcctccttctccttcagcttccaagttcataaccagcacaccttgacaactcctcagatgtccctgaatttgtgtacttccctacatccccactacattctacctcaaacccttctgccgttaccttagcttggaactccatcatctcaaaacacagtgatagctacttagtggacactcaaacctttgctaaataattgaataaggtagcttcaatcatatgccctttaagatactgaggtaaacaagagtagaataacaacaaaaaacccctgatctcattctcttttgagcaaccacttcaaacatgccagtagcaatatctcccattagttgcctaaggtagatacttaggaattatttttgacctttctctcttctctgccacccccataccatctttcctattaccttctcagtttggtttcctctgttgctctcttaggtctcacactacatgtcaaccaaacaccaaatacctcctcaatgtaaccctctaacccagcgctgtccaataactttatgcaatgatggtaatgtgccatatatatgctgccaacgggtatggacactgagcacttggcatgtggcgagtgtgactgaggaactatgtttttaattttatttaaatttcaactaatttgaattaagtagccatatatgtttcatggcaacagtactaaacagtgcagcttaaccttcttccatactgctgatagacatatcttgctacgaaacatctgatcatattacttgccttacagagtgtgactccataaaatctccatcattaggcaggatattcaaagctctttacaatctagaccaatttatcacctcagtctcattagccccactcctttcccatctagtttgcaaaggtagtaggccactcactgtactcacacatgccatgctataacccttttggaagctgctgactcctgcttagaacgccttttcctctcacagaacatctgctcatccttcaagatccagcttaaattcccatttctctctgaatatctaactgccctctcatagctgagctaggctctctgtcttaactctgctgccataacttttagtatgtggcttcattaaagcatttcatcataattaatggtttacatgtggaaaatatgagtctcatgtatgccaggtaaatattaatcacatacattaaagatagaatctaaagatagaatctggcaaagcatctggcacaggacttcactctgagtaagcccacgagagatgtgccaagtcttcaggatgtgttttaggaattgcatcgcccatgctagggatcttcaccaaatacagctgcctaagaaaacagagaggaaaataaaagaatggagatggggcaaaggaaacactcacaaggcattgatagcaatgagaggcttaggccagggaaattgtataagaaaattcatgaaagccccaatagaataagcatgcagtaaacctataggtaaagcagaacttgtttttcaccttccctaactagctggcaatagcaataatcaaattccttaatcagggagtgtggttgttacgaggtcaagaacaagaaaaaggttttcttctgatgtgtaactgagaagaatttgttgtaagcagatcaataaagccctattactatggcccactcctcaggaaagagctctgttttataaaacattgaatatatttgctgtaaggaaattcaacctatgaaagacacaggagaaaaaaaaggctctaaacttactccattttcatgtcctctagaattatatttagatagaaacacttcaaaatcaataatatccgagttgcatatatttccaatataataatttcccctttatataaaggggtcccatttttctctcctttcagtctgcttatgaaagcaatgcagagaaatatttaaatagttaaaggtaaaaatgttaatggcaatcctaagcaatattcaatatatatacaggtatctgaactgagtaagtacgagtcagtattaataatattttgacgttccatttcattggtttgagaaagcataggtttatgatataattttgttattaaataaaatccttgaattggatttgcagattgaagaaaattaatatttggatttagttcagaggttgagtaaattagctcagttcactctgggtttgagttcatggttcagttcaagttcttgataatgagcacatcaaaataaaaaaatatttaaataatgcaatcagggctgacatttaagagcaagtgttcaggcaaatatgtgtttttaaaaaaacaaactcactttacagagagagctaaggttaaatccgaaggtttgagcattccgggagccagcattcatgtagtttcccattagcaatacaagttccagcaacttgctaaagcttttgctcttctttatctcttcgcaggcagtactgacagccatgatgtcaggtttgatgttgttcacctgctcttcaaactgaagcttaaagagaatagcactgagccgtggccgtagtctcttcacattgctcatctgattgaaaagaaaacagcagatttcctttaaaatgcatggtatagtttagtactgtacgactgcaagtaatctgggatgatttattggtatgacagtaccaaagaagaaatatgtctcctaaaactgatagcaggaagagagaaaagccctgcttgtttttgtaaggaatccagagtcatccctcaaaacccaaattaacaatttagatgctcaatgaaaagaaagctttaattaaatgataatgtttaattaagcaataaagtaagcattttttaaactaaattctaaaaaggtaacaagatacataggccacaaattacaaggcattcatgtcattattttgaataatttttgttcaatactgcaatatactgggtcatgtttaaaacacattcagaaaagtctaaagagggtttgttttcttcaaatagcaattgctgtcctcagaaaccctgctgactaacagtatgtgttagatagagggagagtaaataggtcccaatttgtactaaattgactttcttcagaaacacaggaaagtagaatgactcctgacacatactaaattagcagaatcagagttaggaaacatgggagtagtagcaggcagaagcggtgcaaacccacaaatctatcacatgccaagttaaccctgtctgggactctaggtttctctactgggaatgtgggggactggaggtgtctaaaagaacaaaggggcaagttcctgcctttatccttactcctgtgttatatcaacacacatgcaggaaataatcacttagctgtaggctgaagacataccacatatgaagctagatatgaattccttgaccaaacacactagggatttgggacttaaaacgcactgaaggggcggtaatagtaaaattgttgaacttcaacaactattgtaaatatcaaaagcaggttaaggcaaggtcagaaaaaaagcagtgacagattaaaatagggactgtttctcccttagtcacagactgtaaaggaaaggctaaaaaacaatgctatatgaagcctgtaggatgccaaatataatgaaaatcatgattgtttgggatacagaaagctatcagctcataatataataatgaccgttacttaaaatatactagacaaaggcttataagactccaatatattatagacactgccttaatgactaaacataactcagcttactcatctgacaaaaattgagcaataaagaattagttctttgtacacaactctgagagaatattttcatatagaccaaagccctatagtgaatgaaaagttccattttcaaataatataaatatctaatttatacttagctttctccccagacccttgccaaattaaatggttattcatatacaatcaagattctaagggctcaattaatgtagttattaataagaagtctactttacaaggcactttaaggaacgtcttcatattccactgtctaggaaaaacaaagaatgtaagttcaacaaggaccaaaaaaaaaaaaaaaaaaagaagaagaagaaatatcattaagtttatagagtaagtttaagcgatatgaaattataaagagacaaagatgtactattataatgttgattcttattgggcatgaattgttctttttaagcagtgatcacttatcacaaagacatttgtcttaaaatatattatattttaagacagatgggttcacttacctggattttttttatccttaaccattgcaaaaggaagatgttcatatgacactggtaacatgaataatgctctattacacttaatatgtcctttagagcagtcagacatacaaaagagcactcacatgtagtacctgtagttatggccattctgaaggtgtataatgggctcatagcatcgctgttttcagtaagtgccattattcatgattatgaagccaggtacttgcaatacatatgagaagaaattctccagtattctatgcaaaacatttgtattacgaaatatattaattctaacatatattaatgtactactacattcatgcacagaagaaaaaagagactgcttaaatgcctacattataccaccccaaaatatgttaaagctttcctgctgacaagctaaccatatgtagccagcatagagtaattaattctcctagaaaaatataacctagatttgtatgaataatgagtgtatctggcactagggacaggtaccttgaaaagatagagtaagtctatgatgtaatgcagaacaaagtgctacaagttcatgaaaatccctgacaaggcaaagtcaggaaatgtaacctaaaaacaaagctttgaacaacacttaaaaaaaaaattagatgtccttttcctattgttctttcttccaagtttagataaatcagtatttgactattattgagtaaatgtgttttaataaataaaattattgagtgggaaaagaacttgaaaggtcacctggagaaggtgcctgtctttagttcactatttagtcatatgatgacccctaggccaaatggttgccctttttatttaacaacaaaatatcatttaaggttaatgttccaagatctaaatcatggaatctatgataataacagaagggttacttttctttttttgaggcagagtctcactctgtcacccaggctggagtgcagtggcacaatctcagctcactgcaacctctacctcctgggttcaagcaattctcctgcctcggcctcttgagtggctgggattacagccatgagccaccacgcccggctaattttttgtatttttagtagagacagtgtttcaccatgttgttcaggctggtctctaacttctgacctcaagtgatccacccacttgggcttcccaaagtgctgggattacaagcatgagccactgcgcccagcccttttcctcattatttgaatcaaactttatttcttcaggtggaatcaaataaaaagggttaagaagggggaaaatatatgtatatgtaaaaagcccgaccaatgtttccgcatcctcaccacttctcatattctatcaacactggggatttgcattctgttttcctgctaagaaaactaaacttctgacttgtctaagactaagtggaaggcagaaatgaactatggtgctcaaataatactctgaatggcaacagaaagtcatttttaaaaatgagaaaaaggaaagggtaaatgaacaataaacataaaatgtaagctagttaataattagaatgctagaagaaattagaatttcatttttacagttatcctttaaatctattgttacaaagtcttggcaatataaattcacgaaacccaaatctgacaataatgagatgtaatctgaagatcaatccaaaaaaggaaaaatacattgatttcactcctgtttttcctgaaggcagggagcagtactcctgtaacccccccacacacagatgtcatatgtcagaatgaagagatgttaaaagcagtgactggtaaaaatcaagaagcaatatccagaaccctaagggtaattttatttcaaaattttgtttgttggcaatatatgttgttagagagggaacaacgtaaaaagacctttagaaaaatcaatgaactaacaagtattgactgggccccattcagtgctgtgaggggcacaggagccatagcagctgcccctgtagcccttatcgttgaattctttctgcctgtcttaaggagtataaagtcagaaaggtccccaggaagatgtaatctctcaaaatctcattatggttctatttttcacatataattttatccattattctataaggaaaaaaatcattttttacatcaactttgtttaacaccatatctacttctctttatacattttcttttataaatacaggttgtcagatgtttttttcccccgtcctactatgcagacttaacatggcacacctcagaaggatttattttttattcttttttattcttccctgaagttattatgaaacttcactgttcacttaactctctaacagtatagtaacctgctgactgggaagttactggcctcggtcttaatttataatactctaaaagcattagttcatctactttgtagatatcacattataagaaataacagaaaagcatttcaggaaggtgaaatgactctttcaagtcacctggctagtaggacccaggcctagagctaacttgctgctaatcaactgtccttaccactcagagcatcgcaatgtggaaattaagaaccacaatttacaaaccatctggaactcaagcttcctctgctatgttttctagtaggtaagaatgaactttaatttcttcacagtagttatcaagtaacaccctgcaatgagctctgcctgccacctgtactatctcaatatttcttaccttcctccttaatatacccaactacctcctattgtgctgaatctttaatactttttcagatctacttttgttgtctctccacatcagggatcccacaccagtaactgttagaaaacaggctgcatagtaggaggtgagcagcgggcctgagcgagcaggtgaagcttcatctgtatttatagctgctccctattgcttgcattaccacctgagcttgacctcctgtgagatcagtagtgacattagattctcataggagcgagaaccctgttgtgaactatgcacgcaaaagatctaggttgcatgctccttatgagaatctaatgcctggatgatctgtcgctgtctcctatcaccctcagatgggtccatttagttgcaggaaaacaagctcagggctcccactgattctacattatggtgagttgtataattatttcattatatagtacaatgtaataatagaaataaatgcacaataaatgtaatatggttgaatcatcccaaaaccatccccctgccatctatgaaaaaagtgtcttccatgaaaccattcactggtgctaaaaaggttgaggactgctgctccacactacactctccactcatactctcctattagctaattcttcagttctctatgggagaggtatgataagcaagaagaatgtgaaaaaacaaatgcagttttatgaaagacaagagaaaatactttgagaaagtaatgtgatctaatacatcacagaattaagacactagagaaaaaatttttgagcttgatttttctaatgatataaaaaatatctttcattgttaacagaccaatatgttcatgatctccagaattctcagaaaaaaacacaagttcatttcacttggagaaaggcttcaaaaaaaaaaaaaaagctattcaagtgacttatgcctgaggtaatactcagaatatcaaaactgtttttaaaataaatgtactcttacgatattaaagctgctatgctaaagttatttaagaaaactatacaaaaacaaagtacatatggtataatttttacatatttcataggagaaaggtaaagccaaggcttgtacaaaaatattaaaaggctaaaatgtatattcctccacttagtcaagaaataaacaattggctatagacattagagactgctgcacctttgtttataaatccttatcaattctggatcactaaggatttcacaggaggtccaaatgagttctgaagatactcaggatcatcaagtggtaaagctatgattggtaaagctaaagaacaaagagacttcctatttaatttggcagtctcagcacacagtcttaacacataagtttcatatctcttgaattaaaaagctggcataaaccccagaatcatattagtgtcttaaattcattcatgcccgcttccagacaatccccatcccatcgtagaaaaccagtgttttgatttcaatcactatagcttagttttgcctgttcttgaaatttatattaatgaaactatacggtaaacagtttatatagctggcttctttcactaaaaaaaaaaaaaaaaaaaaaagactgagatttatacacacgttgtataattcagtactttgttcctttttattaatagatttccatgcaagaatataccaaaatttgtgtatctactttcctgctgatggactttccccccaacccaccccagtttggagctatgtagtgagttgaattgaacagagacccacaaaaggtatgtctaaatcctaacctctgctaccttgaatgtgatcatatttggaaacagttttagcatacgtaattaaattaagaatctcaagatgaaatcatcctggatttagggtgagccctagactggagtgatacatctacccagaaacgccaaggatcgtgagtagattaatgaagctagcagagtggtatggatcagattctcactcagagactctggaagaaaggaaccctaccaatgccttcatttatgacttctggaccccagaaatgtgatagcataaatctctgttgttttaagccaccaagatcgtagacatttgtggcggcaaccctaagaaactaatacaggctattttaatactttcgtatgagtgttttcatttctattaaattagtaaaaaatatagtacaaatgtatacctaacctaaaacattgccaaagtgtttttgcaaagtaggttatatgattttatattccttttaccaacttatgttttattctagttatcttttatcttttcatgtttaggtccgtactccattcctctaattattcagtaaggtgtgatgcaggagttgagattcattttagtccctaagatgtatagactttacaaaactatttgatacaaagaacatcattgaatatcaaatgatggtatttttgtgggtctatttctaaccttctagaaagcttagttgtatatccttaagccaaaacttttgccttgatgttaaatcagtagtttaggtccaccaagtttgttgttctttaaaattggttttctatattctatgtcctttgcataccatatgaattttagaaatcatttgtcaatttctataataaaacctgctgagattttgattgggaatgtgtgaaattcctaggtcatgtgagggagaaatgaaatcttaacaataccaactcttccagtctataagcataataaataccatttctttacaacttctttcatttctctcagcaatatcttacagttttcagtagaaaatctgcacatatttagtgaaatgtatcccaaagtatttttagttttttttatgacattgtaaataatactattttaattacatttaaatttttgctgtttgtagaaaaaaataactatttttggtacactgactgtattctatgacctttttcaattcacatagacaattaggtcagctgaaaaaaagaaaaagatggtatactttctttcctctaatgtattcatcttttatgttttcttgttacacagactagtacattataatgctgaaaggaagtaatgcaaatagacacctttaccaggttctcaaccataaaagacaagtcatctaatcattcacccttaagttgagtataactccaggtttctcatggatgtcctttatcaaaatgaggaagtttccttctatttctagtttgttgagttttttcataaaaaatgactgaattctgtcaaatgcgtcttatttcgcatgtatttaggtaattatgatttttctcataattaccttgtatttttttatctgataatatggctaactaattaattttgaaatgtaaaaccaaccctgcattcctgggatcaattccatgtggtcataacatactctccttattaagttcagcaatatttgatgcaaaaatattttgttgacaacttttgcatctatgttcatatatgatattagtttctagttttgctgtagtagattcccttctttgattcctgataccagtagtttgagaatttggttgtctttttcagcgcttcattttcatttggctcaaaataattccttctttggcccaccggtaattttaaattaggttatgcaatttttagactgtggtagatgttctattattgttgttgtctaacttaattctgttatagacagaaaacataccctgcaagatatctatattttgaaaattactgaggcttattttatattcccatatggtctaccttggtaaacatttgatatgcgtttaaaaataatgtgtattttgcagttgttgtagatagtgttctataaatatcagaacaagttggatgatagaagtatcttgattttctaagaatttactgattttttttgtacactttttctagaatttattcaaagaggagtgttaaagtctcattatgattgagaatttgtatatttttccatttttttctgccaggttttgcttcataaattttgatgctcaatttttaggcatacatatttaaaatgattatctcttcctggcaagttattatttttgttattgtatactgatacttcatttcttataatatagtttgccttgaaagataccttcttggaaatacacatacccatgatatttttcatgtgctattttattactatttgttttccatatgtcctttctgcctttttccccactgctatgtttgagtgtttgtgtcccaccaaacataaatgttgagaacttactcaccagtgtgataggattatgacatggggcctttgggggtgattggatcatgagggcagagtcctcatgaatgggattagcaccctcataaaagagggtccagagagctgccttgtccctccaccatctcagaacacagatagaaggcaacatatatgaatcagaaataagtgggccctcaccagaaatggagtcggccagcaccctgatcatggaagtcccggcttccagaactgtgaaaaataaatttcagttgtttataatccattcagtttacagtattttgttacagcagccaaaatagaccaagacaacctcttttatcccttttctgctttgtgttagtcaagcaatttttagtattctatttcgtctactggcttaactatgcctctttttatattttctctggtttgtctaggattaatacatcttaatgtatcaatctaattggaattataaaccctgttacgcaatgttttttattacaaattttctttcaaaaaatcataagaaaaaaggttttatttactatttcaggtactcttcattactttttgtagatctgagtttccatctggcatatttcccttttgcctgaaggacaacttttagcatttcttgtagggtaggaattactgtcacaaactctttcagcttttataatactaaaaatgtcttcatgtcaccttatttttttttaagacatccattagatagagaattctgagtttacagggtatttttttaacacctttctgttgagcttcttgcattttaaactcttctgttgacttctgctgtctattacttctatgaagccagcaaaatcttttatctttgttttcctacatgtactgtgccttttatctttttcctcccctcaagatacttttatcattttctctttttctttggttttccacagttttactaggctgtgccatgatatctttttctctttatatttttcctagttgggatctgctgagcctcttaaaccctaagtttatgtttttcactgaatgagacttttttgtccattatttcttcaaatattttgtcagccacaatcttactctcttatcctttggggactccagttacaggtattttagactgaatgatatctacccaataatacctgctgtttattactttattcagtctttcttcctacataactaagagaaaataatcactataaaactgccttcgaatttcactgactcctctgccatctccaatatactattaaacccacatactaaaatttttaatttagttattgaacttttcaataatttctatatagcaattttttttatagttttcatttccctgcaaatattccttaattatgaccatgtttttctttaattctttgaagatcatttgctttagttctttgaacatatttgtagtatccttattttgtctttgcaagtgaaatccaaaacctgggccattttggacttctttttttcttgataatacatcccattttattattctttaatttttaattcaatattgcattcaatattgaatacttacttacatataaccactctcagttctgtaatatcccattgaaaactatttgttcttatttgagcagtcaaatcaatcactgggtgatcatcttaagttgtatagttcactataaactttgttagtgtagctctctggaaagtaagatttgttttcttagaccctctaacttagtgaaactcaatctccaacctgttttccctggggagttcatcaagacgtgctataggttttattagggtgggtctagactaggtctttagggtgtggccctacttcctaaagcaccagcttttccttatttgattgaatgtcaaatatgctaatgaagtgttaagatgatctctgtaatttggcagagccagaagtacaaagctgaacctctagtatctctgttccactctcaccctgtagcagctgctatctggctagtcttgctcagtgtatgaacactccagctcccaggcacagacacaagggagatacccacgtggactactggagttcctttctgcacaattccttccccattagtgctctgccctgtagataccagctgtttcactgccataaattctgatctttgcctcctcagctcagagaactatattctctgctagaactcaaatctctgtaatttaagtggaaaactgtcaccaagccaaaggctgagtattcatgaaacttttaagtttctgttctctcaagaactgcagcttttctctactggctgctcactgtctgaaaacagttgacctggatattttgtccagttttatcaccgttagcagtttatatatgttttgttatatgtattcctaagcattttttaagttttctgatgttgatgtcaacgtaatttttacaactttttactataatttccgtttttaaaatacaaaaaaaaaaatcctgtacccaaattaaacatgctgtccacatactgcttcacttaattcatcatattctttctctcttcttctccacatatatacatatatgtatgtatatatgtatgtatgtataaggtgctctccacaagtttttccaatgttaaattactgtttctttcctttataattaatagtttatggggagctgtttcgaggctatgtaaatagtatgtatataacctattttcaccaaattttcacatttgtatcaacagagatagcacactaactagaaaaatacagaatctactcaactttattaaaactgaactttacggaccctttcagaaacagcagtaccttcaagagcatgacataaaagtgcaaatgaaccagaatatatctacaataatttcactttaagccacaactgcaacaaaattgtctaacttcagtgatttagttccataagtccagcctcctcttttccattatgtttccaaaatagtcttacaagagtataggtaaagcaaatctcaaacctcataatgagatttgaagagtacagaaaaatgattcctaggcactagatgaaagtcagatctaaaagcaaccttaaaacaatgttgtttgcaaagtgatgaatcacaagagacctttttgcttataactacaaaatgctttaggctgtatttcaaatgaatgatgcatggctggtaattagtatgtgactataatgatgttttgttttgtttttccaaatgaaagaaattaagcagattgtgccataaaatttcaacactacatagatggtctaactagaaagcatcatgtttccataccaaaaaaaccccaaaaattatcatcaaaaaaaaaaaacaatctacaattctatgataaaataaaatgcccccactttttagcaggaatttagtggggaagtggggattttagattttaaatcccatataagaaaaagcagaaactaagaaaattttgaaaaacgtactttgaattagccatcaattcaagttcctgcttaaatattctaggtaattttttacctcgaagttaatcttcagctattaaaaataaattgcagaagcatttaaacagggaaaccactgctaaaagcaactttaagtacagtaggtacctatagcaaacagaaacacaagagtgattgccaccataagaaatgaagtatggccttagtgtcaaaaaagcatggttcatagctgagctgtaatagttaccggttgagtaaacaggtcaaaaagttgcctaatctatgtgatggtaatgcctatttctgcagttatatgaaaatgagacttaactttactcattcattgtgtatcaaatatttattgaacccttatttatgtgtcaaacactgatttaggacctgaagattcatattaaacaaacaaacaaacaagcaacaacaacaacaacaaaacaagaacctggtgcacatggaatataccataagtaagcagagggagaaggggagaaaaagagatagaaaaacaacaaacaaatcagatcattttaaacaaaaataaacgctataaataaatgaaaaagagggtaacatagatagagaatgatggggggcagcatcattataatgaaaacttctataaggaagtggcatttgggcccaagaggaaacagcaagaggaaaacctaaaatgagaacaagaaaatgtatatagctcaaacagtggaaaaggacaagggtagtaaaagttgggattaaagaaacagagactacattatcttataaattatcatgaaactggaaaccattagaagggtcaaagaaaaaactgaaagaattcattggcactaaaagaaatgttaaaagcatttcttcaggaagaaaggaagtgatttcagatagaagtctagatttataaaatgatgtgaataacactggaaatggtatataggtaagtagatataaaagactctttttaaaaaataaaaagacttaaaatttctttcaaaaagaaatactccaagtcctaaagcaccaataatatagcaaaacaaagaataagagtgaataagtcaaaaaagataacacagactcattaaaaatactcaatccaaaagaaggtagaaaaagagtagcaaagaatagatgagataaatagaaaataaatagtaagatgctagatttaaaccctgccatatgaataaccagattaaattaaaatggtctaaacacttcaattaaaaggcagaaatggtcagactggattaaaaagcaaaactcaatagactgcctataaaaactgtaggttaaaagataaaggatagaaaaaggcatagcatgcaatcactaatcaaaataaagctgaagtggctatattaagataacacaaagtaagtttcagaaaccattagagtatttgaagtttgtgaacgacataaaatctcatttaataacaagagtcagtagctgctatgtgaaaatagtatattcaaaacatgaagcacaggtcctgaaacagtaaataacaaatggcaaatacaaaaatacatatggtatgatgaaccgccatagcatcagcatctctaacattacatcttttctcaacaatattgttctaagattaataaccatattttattctactttaaatgtggctttccattgccatttcattaacatttatgaaacaaacacactataagcatggcaacccctgccgtactttcagaattttatttaacaaaagagggattatgagaattcattaaaatactataaatgtgatacttacattctagagtcacttggctaaatcctctgaacttgcaagtggttaattaactacatgttcaagattgatcagtggaccaggtaaaggtcagttagtcacagagtaaaagggaaagctggagctggggaggtaggatccaaacaaaacacaatgcagtcagatccctgaatgcaattccagccagctaatggttttatatctatctttaaaagcagacataaccagtagacattaaagttcttggtggtcttctagggaggcagggtcaggggtagagatacagacagtgtgacacaggaaaaagccctctatgttgcagattagtttattcaaaaataatgaacaagagaacctttttctatgatatttgctaaccagctcatatttcgaacaataactctgcccacatactcttaaatgactaattccttgccttaagtttaatctatgcgattttacaattcttgttttttgctgatgccaggatattaatgacaaaagtgtttctctatattccaaacataaacccattaagaacgacagcttgctgtgtttcttagtattgattgtatgcaatttttattctttgtttctacgttaggacaagtaaaattcattcagggacttctaaaaataaattggtagcctttcaataattcatctggtatttgggttatgctttatttcaagccattgatttggtgggtgcattttgggagcattcagatcaaatcactgtgatacattttttttcaggcaactcctctgcccttcagtaataaagtatacccgttgctattgtctgaggatatcagaagggccaggtctgtgatctgcaatttaagcagaatgggagatactaaaatgtgggaagacaaaggaaaacctactgaagatgggacatcaggtggcattcaggtaacggacataataaaggatgaggctataattaaggctcgtgggcataaaaaaaataggcagaaacctgcgttttaggaagtacaggttgaggaaacagtggtctctaactgctaagagagatcattaatgaggccagcagtcaaaatcatggataattccaaaggaagtggtaataagaattcagtaagaagtagctaagaccacagcagacatagtccttcccaggagaaaaaaaaaagaaagagagaagaaaaggaaagaagtctcccctgcccccccacccctcaaaagcacataaatagaatgagaatagaacagacaattgagcagtaaagaaaaagattgtcatgaagctaattgaactagttttctcttaattacattaaaaatatgaaatgtttttggaaattctgggtcagaacttaggaaaaacaaatacagtgtcaaggaaacttataacaatattaagctgctggaaccttaaatcttttcagaaaatactagcattcaagtgatcagaatgatttaggcactttactgtggctagtgattccaaggagagctacttaaaaaggaaacattgataaaatagggtagaaagactccatttgtccaaaacataaaacttcagtaatgccacatagcttaccataagaagatgacacataatgctacaacaaggaacaaaatattgacagaataaaaactgacctaatgacagtttcagcataaagccacaaactgagaacccttaaacaaattaaaatttatattactaagttttgactatttaatgcataaatgtaagtcaatatactgtaagtgggacagtataaacacaaaaaaaggaatttcctaacatataacaatttgaacaaattcctagattttccttggacaaatatagtaaatcaaattatttggtagtggtgatgctggtggcatataagttagtgctagtgtttcactaaacgggaaaaaatcactttggctattcggtatccgctcttctaaataactgtaatatctagacttggatataaaattggcatccttggaaaagaaagaaaaatagcagtaatggaaaatagcagacttgcaggataggaaacttgatccaatgttaaaggaaaaaaaaaaaaacaaaaaaaaaacacatttatcttgtgaaaagagccaagtctggtatggaagacaaggatgtttaatgacgcatataatttaatacaaaataaaaatataagaaaagcgaaaaagggaagaaaaatcaactcagacaaagactataattaaccaaatacatatggggccaaaacactaccaccctttgtctcaggagccacaacgtgaatgaagttaaataaaactgtttaaaagttgattctgagtatctcagagaaattttcaagtgcttggcctcagattgccagtttccctgttaagctgaggacagaaaatggagaaaggcctactcaagagaagtcagtggtcaggccacaagaataatgagccagacgaggtagtcgacattctagaagtgtacacattcactgggctctttaaggatggacaggggaatcctctcccatttgggtcttttatttctgaagacagaaaatagggacaagattgatcctaaacaaaaacgtaaggtaaactctatttttaaaaacctttccctttgcattcatttacctttttcccacctcctgtgtgcatctaattctttgccaatatatcaagaactctgtgcctaaaaacaacacagtgtggtggaaacaaaatgaaatatggaaatgtaagtttagaaatccgcagtttcaatctttctcttttgcttatggcatgtggaggaggtcttggttaagtagtctattctatatgagtttctgttcttataaccctgaggagctattataaacaatatgtcatatacatgtatataaacatactttgtgaactgtaagtcactaaataaacttcatataactgctatgtaattacttgtctgctctatagtggctcatttgatgcgatattatgccattaacctgaaactccaaaattcacctctctccccgctccctttatccaaaccatcatcttttgagtatcacaagtcacagataccatattttaaaagttaatcagactaaaggaatgcagagtaagattttaatctcctctaggtatcctaaagcattatatgatttacaaacagaaggctgacctgatgttttataatatctcaggtagttacatgaactgcagtatttttggtgggggaggcgggggtggaggcaggggggtcggtccttgaacatacttccgtaacaactattaggctgttattatacacaactcgttgattttaatttcaggggattccgagaaatccgggatacctagtcagagagttagaggtagaaagcttttaaaggctcatatttctagccccaacatgtgcaactaatatcagaagagaagcttattctaattacttttttagtaatttagattatactcttgaaacccactgtgttgaaaagaaaataaataacccagcactgtgtctcaatatgagatctggaagtcacaataattgatcacactgaaatgctcatcagttagtatctacctttatgtcaacccctatatggcatcccctttgctacttttcactgcaatcaattgtgtctacttgaaagccaaagtatagaaagtctggaaggtaaaaattgctcaaaaagagttattaaaaaaattatatgtgttttataaaatcattgagaaagaagagggtatcaaaagaagagagtagaggagagcatctgagtaagattcttattcaagtgttagaagatatgggaaaagagtcagggaggagtcagacattagaagcacaagggagccaggaaagagaacaaaaagtagatataattaatagggtgaaatgctgaccagaggtcaagaccacacaaaatgagaaatgaaaggacctaagctgaatctggaattatgaggttgtctatatcacaaagagaataactctacgacagtgatgggaacaaaagcatatacataaaacatgctaaagaatcgtagaatagtgagagagaaaattcttaatgtaaagtggaatatagttcttaaggaaagtgggtgctggccgggcacggtggctcacgcctgtaatcccagcactttgggaggccgaggggggcggatcacaaggtcaggagttcgagaccagcctggctaacatggtaaaaccccgtctctactaaaaatccaaaaattagctaggcatggtggcgtgcacctgtaattgcagctactcgtgaggctgaggcaagagaatcgtttgaacccagggggcggaggttacagtgagccaagatcacgccattgcactccagcctgggcaacagggtaagactccatctcaaaaaaaacaaaaaaagaataagaaaaaaaaagaaagtgggtgctgaactggatcacaatagatgagaagaaaaaagtgtaaaataaaaataagagaatgaaggctgggcgtggtggctcacgcctgtaattccagcactttgggaaaccgaggcaggtagatcacttgaagtcaggagttcgagaccagcctggccaacatgttgaaactccatctctactaaaaatagaaaaaaattagccaggcatggtggcacatgcctgtaatcctagttactcgggaggctgaggcaggagaatcatttgaacctggggaggcagaggctgcagtgagctgagattgcaccactgaactccagcctgggtgacagagtgagactctgcctcaaaaaaaaaaaaaaaaaaaaaagaaaaagaaaaaagaaaaaaaaagagaatgataacagcagctaacataattgggcatttgctatccactatacactacacacatgcatgctctcctaatctcaccacagctctgtgagacaggttctatattcacgtatattttaacaaacaaaggaaatgaaattgaaagatagtaagaaactcatacaacgtttcataactagatgtggtaaattcagaattcaaacccaggtcttcacaatcagattagaaacacaaggaaggacagttgaaggtttctggaatactaagacaaagttttttttaacccagattcaagtctcagtactaagaacatattgccaggcaagcctcaataagccaagagctaaatgattttagtttttcatatttaaaataaataaagcatctgagagaaatttacttattcattcatcaatatttattgtataataccatatattgtttgaggcattaggaattcacaagtgagtacctgacagaatgattcctgccaccatagatacttatggcaggctaactaggttagtggacagagcgtaatacagtaaatgagaagccgatgagtactagggagaaaaataatgcagtgaagaggtgtaatggttaatattgagtgtcaacttgtttggattgaaggatgcaaagtattgttcctgggtatgtcttgagggtgttgccaaaggagaagattaacatttgagtaggtggactaggagaggcagacccaccttcaatctgggtgggcacaatctgatcagctgctagcatggctaggataaaagtaggcagaggaacatggaaggactagactgacttaagtctcctggcctccatctttctcccatgctggatgcttcctgccctcgaacatcagactccaagttcttcagcttttggactcttggactgcaccagaggtttgccaggggctctcaggcttcggtcacagactaaaggctgcagtgccagcttccctactttcgaggctttgggactcctactggcttccttgctcttcagcttgcagatagcctattgtgggacctcaccttgtgatcctgtgagtcaaaactgcttaataaactccctttcatatatacatctatcctatcactcctgtgcctctagagaaccctgactaatacaagaggaaaagaagtattttgagcaactgattatgcaatttcaaagaaggtgcattgagaagacttccacaaaggacctgtgaaaaaagaccagaaagaaatgagagaacaagccatttgaataactggacaaggcaaggtacaagtgagaaattctcaagaatgtgactggcatgtttaggaaacagtatagaagccatatgattaaagttgccttagccagggggaatggtagaagatgaggtaagaaataccaaggcagggacaaattatgtagagccttgtagactactacaagaattctggactttcctctgaggtgggaagtcattgtagggttataggtaaaacagaacattatgtgactgaagtcgttggctgttgtgttaagaatagactgtgttaaatataacttgagatgctatatcaaattctttcacaaattttacatgcacgtgatataaaacacaagcaaaattttgtaccttttgccatcaattaaaaagaagagagatcaatataagtcacagttgaaatttcaaactttttgagaaactcacaagttattagcagctcaaggaaatagcatattattctgatcatgctgggtttttattagttctaataaattaaagaattgcagagttatttaatatagctgacattctactaatttcaagggaaaaagagtaacaaaagctcataagagaattcattcagagctcaattccacttatcctcccactctacagagaacacaattggcagcatgtgagtgattttttccctgtaatggcaggatttgatattactattttgatggagatttgaactaaataagctcaatcccttgattaaatgagagttattttataaaggaatatgcctgcacacttctggcattttaactttatcttagttcataatacaggaactatatatttattatcatgatgtattagagattattccattttcttccatatgagagcaaggtctggaggcaaaaagttttttttctttcactgcacagacacacgttgtcatggccactagcttctttctaaatgtccctgatgaattatataccctacaaatgccaaatatccctctcaccccaactcatggttagtttttgaaacaaactgcaatagtgttatatataaaatcaccttgtacaattccctaggtaagggattgcaattgtcctttgagaggtgataaccagcagcaaaaacaaacaaaaccttgctgatgatgtgcccctctccagggagaagactgagaaaaacagtaaggtttgcatatttcaccttgcccttcactgcctcttgtgttacatttctaattcactccctcagtgatttcatccactcctatagctttgtatgtgacctgtatgctattggcttccaaatttataactccatccctgaactcccagcttatacccccaaatgcatgcttcatatgtccactaagaggtcaacagacccttagttatcttcccttccataatctgcttctcttgcagactttccctcatctctataaatgggaactcttatctaattttacagcctaagaacctggagttattcatgattcctcctatgccccaaatccaatctgtcagaaactctaattcactattttcaaaatcatccagaatctacttctcaccaatgacactgctgctaagcctgtcaaactaccactaattcacacattaataatgagatcattgaaatagcttgttaaccagtcactggctttaattatattcctcacctcaccctactatctgtttctccatatagctgccagcataacacttctatggcatcagtctgatcatttcacccctttgttaataactcactaacggctttcttaaaataaaatccataattctcacactatggctgcaaggccatgcatgatcaaggccctggtggcctctttacaccgtctcccaccttcactctgccacagccactggcctcacatagccaaactcacttatccctcaaggccttgctgtttgtggtctcttctgtctataacatgcttccttgagatatccacacctctaactaaagtcactccggcttctgctcaactcttacctcttcagaaagtccttcctaaccacacaaattgcacacacaaacacactcatcctaccacttcctgcagagcattcactactatctgatattacattattatttatgcatatattgctaccatccccaataaaaatatatgacaaatagggactaagagaaggatcatcacatttaactcagagtctgcagcaatacctagcacacagtaggtgttcaataaatatttgtcaaaaaatgaataaattattgctgaatcaaggagacaaagtatttgaagaaaatttatcagacaatggtacagtctaccaatacaaactcaaagtctaagtttctccaacaaaatccaagtccctgaaacatccaaagactgaaacatacactactggaatagttgctaccaggaggcattccccaggctgaagtgcagtggcacgatcttggctcactgcaccctctgcctccccagttcatgcgattctcatgcctcagccacccgaatcatctaatgagagtgcaaataaaaatgtacaaagttcttaagtatacccaacctatcagcagtaaaagcaatgttaagtttcaccattaaaaagcctctaattttccatgaatgtcactatatttggttaaatcaatgaatcagttacacattattttgactgttaaacatgtaaagaaaaactgtgtatggttgatatggtttggatttgagcccccatccaaatctcaagtcaaattgcaatccccagtgttagaggtgaggcctggtgggagatgactggatcatgggggtggatttccccctttggtgctgttcttgtgataagagttctcaggagatctggctgtttaaaagtgtgttgcacccccctcccaccttactccttctctggccatgtaagacgtgcctgtttcccctacaccttccaccatgatcataagtctcctgaggctttcccagaggctgatgttgccatgcttcctgtaaggctcgcagaactgtcagccaattaaacttgttttcttcataaattacccagtgtcaggtgtttctttatagtcctagcactttgggaggccaaggcaggcagatcccttgaggtcaggagttcaagacaagcctggccaacatggtgaaaccccatctctactaaaaattcaataaatttagccaagcatggtggcgcacacctgtaatcctagctactcgggtggctgaggcatgagaatcgcatgaactggggaggcacatggtgcagtgagccaagattgtgccactgtacttcagcctgggcaatgaagtgaaactgtctccaaaaaataaaagtaaaaataaagtgacaagaaaaacaatgactgaatgcttatcttaaaagatgcatacctctaagatttaaaatagctagaaatatagttatgaaataatagtttattatttcaaaccaatgttctcactgtgtaatgaaagatttccagacaagattaccaaatggccatctaaagcaccatagaacttgagggaccttggacaactggacaaagcagtagcagtggatgaatggaacttctcttttccaggaagagaagacagtagattctgccaacttcagactgacacaacttatgtaattgacagacgagatcaaagatgaattattaaacagaaaaggaagtagtaattacaagaaaccaaaatgggttcttgaaaaaaattatatcagagtaactgtatgtctttgttaggagactgaactctgggaaacatgattgattttgtatctggacatttgcaaagctttgaaatattcaacacctaaggaatgcaagaaagacttggagatatttagtctgggaaagtgttggtttggtggagatatcctttcagtttcctcacctatcttggtcaatgttttttataagtgtttcagtaagccatgattcttataccaaatcacaatttcctcaacatcttttatgaaataaaaccactaagtactaaaacaagtattgtatagagtaccatgagtagtcacactcaaaacaacatggccttctgagttaaaaatcaggaaaacgttcaatctaagatgttgtactagacaaacctagaagttaaatggcaagatcacttagggtttaagttctattctttaaaaaaaaaaaaaaagtgtgaattatgcaccaagttattgatttcttggtctacttttgaattaacccattttcactcatagagaaatcatctacagattcatttttaacaaaaaaatcaaaaatactcaaaatgatttttaaaaacactgttttcattttattgttcttgctatactttttccatcctttctgttcatctattctttatttcatacattcacttaacatacatgtatatgttatgtggcactatgtgtcagtagatgtgccatgtgctgggaatagaaagatgagcacaatacactctagcctgtcaaaaagttcagagcataaatgaagactgtgacttgtaaaataacacttatattccagtataatacaagccatttagagatatgcacagagttctctggtaacaaagaggaaagatactgaattttgtatagaatgaagtgttagggaaagctccccaaagaggcttcctcaaaggggaaagaagggaaaggcagaatattgacaggcttgagcatgatgctttcagagctcaacaaattgtctagcaatgatgaggcagagagaaaaaaagtaagataggaggtagaaggggaatgttaggaactgcttcatttaaagacgtaatgctgggtgggaaggacgggattacagatgagcctgaggaaacatttaggggtaatgggtatcttcattatcttcattgttgtaatcatttcatggatgttttcatatgtcaaaattaatcaactgctgtactttaaatatatgccatttattgtgtcagtttaccgaaatgatactttttttaaaaagttttaatgctattctaagaattttgggtaaccgtgtgaaaggctcggggagcaactgaaggaatttagagtcagtgaaacatatttaggggcatttcattctccattttacatctttacaagatcctctatttaatcaaattaaagaattaaccaactgctattttccatgcacctgtcatgtacaaaggaccaatgcgtccctaaaaaaaaatcacatctctatcgttaagtgagttatgcagatcttcattttaattcacttttaaaaccaaacttcaaagatgcaagatacagcagacgtcataaataaaaataaaaagacaagtaagaggcagtgagaaaaattgcaaatatttacaagagtagcgctatagaacatataaggagctcttacaagctacaaggcaataaaataggaaaataaacaatattaataggcaattctaagaaaaaatataaacaaccaataaatacataataactgcttcgatctcatttaataaccaagaaatatgaaataagtaaaataaaagtcaccaactaaaaaagaaaaacaatattaatgattatgcaaggaaaagaatcctcacttatattattcataaaagtgtaagtttggccaggcacggtggctcatgcctgtaatcccagcagtttgggaggccgagacgggcagatcacgaggtcaggagatcgagatcatcctggctaaaatggtgaaaccccgtctctactaaaaacacaaaaaaattagccgggcgtggtggcgggcgcctatagtcccagctactcgggaggctgaggcaggagaatggcgtgaacccgggagccggagcttgcagtgagttgagatcgcgccactgcactccagcctgggcgacagagcgagactctgtctcaaaaaaaaaaaaaaaaaaaaaaaaaaaagtgtaagttcacatgccttctggaaggacaatttgacagtaactagcaagattaaaaaggcctttcaatttagcaattcaaagactaagtatgattgtgagatgatttacatctcttcactctcaatttatttaatcctcagaacaatacaatgtaggtaggcactattactgtccctgttataggcaaaataacggtccctcaaagatatccatgtcctaatacccaaaacttttgaatgtgttgctttacatagcaaaagagactttgcagatgtcattaaggatcttgagatggggaagattatcttggattatctgggaaggcccaatataatcacagggtccttataagagggaagcaggagggtcagagaaggggttgtgatgccaaaaatagaagtcagagcaatgctgaaccatgagccaagaaatgctagcagcttctcaaagctggaaaaggcaaggaaataaatttttcccctagagccctcagaaggaatgcacccaagctaaaccattttggactattgatctccagaattgtaagatcataaacttgtgttgttttaagccaccaagtttgtggtaatttgttatagcagcaacaggaaactaatatagtcctacttcataaataagaaaatggaggtatcaaaaaatgagtaacttccaaagatcatatagctaggaagaggtacagctagaatttaaacccagacaatgtgcaatactaatgcactgccttcaaatacaaagatgtatacagaattattttttaaaaaacctgaggcacggagagaaactacaactaagtgtccttcattaagagaatgattaaaaggaaaaatcataatatgggctatgaaataaaatgcacgaatttaaaaacagtacaacatgaaaaacatattcaaaatatatgacacagccaaaaagtttcagaacaatggattttttaaaatgttcacgtgaacatgcatacattggtaaatacacagaaatggaattagaagtacaacagattgttaaaaatgatcatttgtgtggaatgaaaagaggtagtgggatacgggggacatctacattgtattcaatatttctatgttatttgaatgttttacaacaagaatatatgatgtattttaaagcgagggatttttaatgcagggagatatgcacgaatttcctacaacatttttcattaaaaaggcctcagctgcacaaagtttaaaagccctgccctacagtgacaccaaatggtggtagatcaaaatacagcacacaaacaggacatttgttcgattcaatcttcctataaatgtttgatttctttgaagaacaggaagcttaacagaattaaataacgtggagacaaatactcaaaaacctagaatttttaatcaaagaaagtctagtacaccaagcttcaactgcaaatttttaggcctctttccaaacttcagctaatcttctgatcccactgaatatttacataaatcatttctcacagttaaagcatgccactgtgaacacagtgattttacctaatagcttattgatcaaagaaagcctacaaatacaagaaatgcagtcataaaactaaagtcaggctctactccatcggaatcaacccttggtaagtaggtaatattttggaaagatggacgagaaggtgttggggataaacagggatggaaagaatccaagaagagacacaagcaatgactccaattaatgacaaagtatattttcatttgttaatctagtgatagaaaattaagctgagtaaaagaggaggctattgcctctcaaatatacaccaatttctccacaagaaaattttgtcctggactgtccagggaaaagaatatttcaaattaagcacatcagtcagtattcagtgtcctctgcccagaacctaaaccaacaaaaacagcatgtaaatggccttattcattacaagccactataaaaagatacagagatagaccacctctcagggcactcctctaaaacaccatttggccaggatccttagtcttttagcattaaatgagagtttattggatttttgatgtgttacttttcatataccaaaatctcctagaaaacacaggacatataaatatatgatcatctacaaaaaaaagtcaataatataattaagctctaaggccttgaaatcatataactggatttcaatcctaataggtacaagccaacttacgaccacatgttaccagcactactttaccccactcatggataatcagctctagaacaccttgagagctatcctgatcaaatgagtgcatgtccagtgacaagaaccacaaggagatcagttcaagaaggtaacttaagtttctgaattactatataagtgacagatgaacaactaagaactgagtaccacaaaaagtatccatgtctactacatatacatttatgacttaattagaaagagaggtaatatcagcattaaataattttgcttccaatttcaacagagacataaatatgaacatgaaagtctatattacagaaaatgtgaaaaattaggcacatcacatggtttagtggttagaagtttcaaggatatacaatttaatagaaattgacataattcccacagtaaatttgtataccatactctacaggatatagagccctagaaaactgtatctaagtgatacatgataaaagtaagacatatggccgggtgcagtggctcacacctgtaatcccagcactttgggagatcgaggtgggcagatcacaaggtcaagagatcaagaccatcctggccaacatagtgaaaccccatgtctactaaaaatacaaaaagttggctgggcttggtgttgtgcaccaagctgtagttccagctactaaggtagctgaggcaggggaatcgcttgaacccaggaggcggttgcagtgagccgagatcgtgccactgtactccagcctggtgacagagctagactctgtctcaaaaaaaaaaaaaaaaaaaaaaaaagtaagacatttccagtatacaaactatttctgatatatgctaattgaccttaattgacattggttactaatattttagatgtcttacttttacaccctgcctttctatcaaagaggaaaataacataaacatcaatatcctggtggagctacatcttatgttttttaactaattcttatggagaattaaagttgattatataatgcaagcaacttgactgaatttaatctactgtctcaagttagggtatcagtttaaataaaacacaacctttcagaaaaaattgtaattaatatgaatcaaattaatgaattcacataactggataaaagaaaacttaaacttagtggcaagtaaaaactgtagaattttaactaatttttgttcaaatgaaaatgctagaaatcataacatcagtctacggaacctaaagatgaaagagttaagagctaatttttctacagtgaaaaacaaatgaaaagtcaagctttggtcctatttggagctgggaaagcactaacactaccccaaactcttgactttttcttatatctaactgtgtgatgatttttcaggtaaagatgattagcacatttctaatgtactttaaatctaggctaaatcaagaagtaaacatgtttttaaggcaaggatgtcttgtagaaatctggagtttaattcacttcaagttaattgcccatttttgatacaaacacttcaaaaagtttattactttaaaaatgaaacattattatggaagtcttacagaaatacacttggcaattataaccaatttcttaaaatcatcaaattactgtattattgataatgttgataaactgaaaacacatcattctttagtaagttagcaaaggtttttaatctagaaaggagtacagaaaatttcagacattccagactgtctaacactctttgtccagtattttgttttttttttttttggttaattatcaaggattgtttggagctttaagcaggtttcccacttctctttggagagcaaaagttgagaagtagtagcagccagattggaaatggtgaaaaatagaaatggaaaaaggtaaaatctaagaacattactatttgacaaaaaataaaataaaaatatttcattttgttcctcaactttcattctgatttttccaccaatacaattaccttttaaaatattagtaccacagaaaccagaaccgaaaacaatttgttcaagagtatattgtcataatcaatagatgactaaggcattgttcatattgtctgtagaggatgtttttcaacaacgttattccttccaaattatattccactggcactcaggtatgacccagcatggaatgtgtacattccagattaagtttgagttgacatgtcctgaaagggaagtggtccatcaccatcttaaaatcaaaactattacctctagcattggtatctgggaatccagttgttttaactgctgatccctaaaagtacactttttgtaaatcaaagctctttgatgtgaattcttaatttttaacaaggcataacttggctattttaagtaaattgaaaatatctgcaaatttgagcagtcttcttgaatcactagaacacagaaatagttttaaatctttactataatggtaggcaacataaaaagctacttgttagatagacattttcatataaccttgcatggtatcagatttaatgtacatggaaaatatttcaaaattgtaattttatatattattttaattcaagtgtcaaaacataggtaaaaaaaaaacactctaaatagtctgtggttaaaaatgtaatgcaaattctcccttattcacctattctcttatggaagacatggcaaatagagtatcaaatagacaaactaaccaaataatagaaaagcaagcaagcagggaaataaagaaaaaagaaaggagacagaaaaggggcaggcggggaagagaataccctgaagaattggagtaaaaagtaaaaactttttttgttttcttaaagacaacgaatttaaaagttttagaaaaggccgggtggggtggctcacacctgtaatcccagaactttgggaggcggaggcaggcggatcacctgaggtcaggagttcgagaccagcctggccaacatggtgaaaccccatctctattaaaaatacaaaaaaatagctgagtgtagtgttggccacctataatcccagctactcaggaggctgaggcaggggaatcgcttgaacctgggaggcgcaggttttggtgagtcgagattgcaccacttgcactccagcctgggcgacagagcaagattctgtctcaagtatttaaaaaaaaaaaaaaaaaagttttagaataagaattataagactgtgaacaaggaaaatcatgctttttccttttgtgttctatttggagtttttttttttttaactttggtggtagcaaggagtagaatgcgtttatgaagagataggaaggaatgtaaaagcaaatgtctacaacatgccaaaatatgaggtgcaggcacagctattaagtaaatcaacctgaatttttaaaattctgtcaaacaaatttcatcctggccctggagattattaatataactgaagatgaaagggaaaaaataaacaatcttattagagaaacaacactatagtattgttataatgacaaagtgtaaccgacctaaaaataataatttaatggtaggagaaaagagcacagaaaagaaatcttgataaaaatcttaaaattttaagttgtaatacatttaatatatggcattggaaattcttttcacctctttagaccccagcttctataaaataaaaggctggagcaagatgattatcaaagattttctaaaatgaattcatttttcatcctcattgccaagaaagatactatatttataatttcggtctaaactacgagatgaattcaagtaagtgatcagaacaagaaaccaaagctactcttgcaatatgttggaatacacagctctagaataaatcacaaatatacctctctattcttaagaagtacagtttttactttacattttaacattaaatagagagcaaaaaaattatacatacaattttcaaaagccccttggacttcacttaatgccagagtttcaatatatattttaaatcaaggtaatttcacatgaatatccttaagttaaaaaaaagtaagatggatattaaatgtatgtgattactcacatgcttttttacatttagcgatataaaaacagttgacaggttctcttgtttggcacagtataaaaatcctctctgagactcggtacttaccacaaccacaaactgctcaggttcacataagttgctatattcactcttgaactgagacaatgaatttaattgctcttgatcaggaagatgctttattaagttctaaaaattaaaaccagaaagaaagatcttcactaaatgtacttcttgaattttaaaaatataatttaaaaactactgaaagaaaaccagtgaagttaatcttcagttttatttctaggtaacctccctcctaataagccttaagcaaaattccctgcatcttgaaaacagtcaattttccatttctctatcccagagttattatatattcaaatcaagcactactgaaactgaatgtttatttgattagctatataattgagaaagagaactcaacctataccaaaggaacagctttctcacctggatgaatgtgatccattacatttcagctttagggaattaaatgtcagaaatttcaggcaaagccaaacatattttaacacttcactcagggggataaaagaaatcatcatattgctacaaaaaggcatgggaagggacagaatagaaatcaagggaattttaatggcagtgcttgcaagatttaccaataggattacagttttaataataaaaactgaagatatctctaaaacaaactaacttttctgatgtgaaagaaaattttaaaaggtgttgaagacacatgatgattgatataccttgcagataaaaggcatgtagaggtcctttagaaacttaagtaagccacacacttaaacaacagaactacttgaataaagattaaaggaatacacaagactatgtcttcctgatacaacttaaatgattaaacaatcccttggacaaagtctatatcgatcctctgtatcaaaatacaatcaactataatagcgttacaagaagttagtgcattgatattaaaattaagataaaaaagagtggttggtgctcacaattccaaattacagcatgagtaaattctgtacaagcccaaagttgaatacaaactataattaagcctagatcatgctatatatatttatggggggaaattccccaaaggtgttattagttaaaaatactgttagagaatgttatacatcaaaatcaattagatcaaagaataagttattgactcactgtgtacctttggacaaaaacttggttaactggccaaaaacaaaacaaaaaaaaagtggcattttaagatcatccctagacaaagtattcactattaatactatcaaattgaataaaaataaaagtatatgatttccccacataaatagaaatttctcttagtggaattgcttgagaccaaaagacatgattatttatatttttacccattctagttgacagctggattgttagattttattacttcaggcctctgaatttctttagcatccttttagacaaatccccctgaatatctcatatataatcagattttcatctttcacctgaattttttaattttttcactccattaattttacattctaacataaaaatactattgtgatttttaagtgcgtggttccaacctccctttgtctctccccttacaaattccccacacccttcgcaaatcttaagctactgttcagctaaattctgcacagacaggcacgcatgcccagcttccctcacagcccacagtattattactgccaaaacaattgcccttcactacatttttcatgcaactcctctgctctattctacatctatacctattcaacatttacatacccttgcctccacacatacactcacaaagcatactccctcaacatattctataggtctaaaccaatcttaaaactttgcttaccttgctttacaattatgtatgtaaatgtcatttcccttgtcaaattataaattccaagaaggtcaagtctaattcttattgagcctaatatacagccgggcatggtggctcacgcctttaatccagcactttgagagaccgaggtgggcaaatcacttgaggtcaagagttcaagaccagcctggccaacatggtgaaaccccatttctactaaaaatacaaaaattagctgggagtggtggcgggtgcctgaaatcccagctactcaggaggctgaggcagaagaatagcttgaacccaggaggcagaggttgcagtaagccgagatcgcaccattgcactccagcctggttgacagtctcactctgtctcaaaaaaaaaacaaaagtaataaaacataaaaattattgagcctaatacaatgccctggacatgttgcataaaataaagtatatgaaaaatgaattaataaatgactgatgtgacaaacaaaggtaaatgggtaaaaaatgatgcagaaaagtggcatgaaaaatggcaaaacaatgacatactgctgacctgtacatatatatgaataagtaactaaatatgtcaaaatataaccatcacagtgaacacagagaaccaaaatcatgattattacaacataaagctctgtttccatgccctggtcaaaataggaattcttcgcattaaaatgaggaatatacttttaaaattaagagttcaaatagcaagaaattcttactttttaatgaatatattaaaaccttatatatgttcaaaataaatttttacattttagaaatacccaaggctggttttatatttagaaagtatgataggcacaataatgacatccattcctaaagatgtacatgactaatccccaaaacctatgaaaatattaagttacatggcaaagggaatttaggttatagatggaattaaagttgctatcagctgaccttagagtggttatcctgaattatttggatgtactcaatgtaatcaaaaagttcttataagtggaagaaaaaaacaatagagttggacggagatgtgactatgagacaaaggaattgaggaatgcaagattgctggcttggaagatgaaggaatggttctacaagccatagagtatgagcaaccatgagaagctggaaatacaaacagattcttccctagagcctacgaaaagaaacacaggtcattctgccaatactttgatgttagcatagtaagaccaatatcagacttatgttttacaggaatgtaagataataaatttgtattattttaagcaaataagttcttggtgaatgggtatagtacaaataaaaaactaatacattacaaaatatatggagctgaatgtactttggacatgaattttaaaaagcaaatcatctcttttctattatataacaaaaccacatgttcatttaaaacattcatgtaatcaagctaaaagctactctgtaaatatttaactaattcattataagaaatacaaacaagtattaagtagaaaaattttatttaaggaagttggcatctattcctagcaagaaggcacacatataatcaacatgaacgaagatgaaaatccagtaaaaaacaaactgaaagagaaaaaaaatgcttaaataagagtagctgaatcaggtagtttatgagtctcagcgactcacagcacaaatcactagtgaaattatatgaccactacatttagaagacaagataggaaaggcaaaacttagaacaacttccaaagatatcatttattgattagttaaaatattcagaataattttaattgcttgttggcactaataaatatttggtttctttttattgctaagtaatcattttcctaaatatatccgctatcagaacaaaagatggtaagctgaagataatctctcactatataatttgtgttttgattctccaactttaaattttatcaagatatacattattgatttcttatgtggaactcagcaataacttcgacatgatgctagtattcatttgaaaatactatgaataaaagccattaacaaaaatcttctagctttctgaataaattcagaatactatgtaaacaatctctaatactcataggagcccaaatgactctaagaagaattgttagtaaaggtaactgtaattgaaaactccctcaatcttctaaaccatataataatatcttcataagccaaagaaaaacacattctaaaagggctatagaaacaaattttaagtaacacattaataaagtataacaaaaacaaaaatgtaaaattaaacaatttgcttttcagaaacaataacttaaaatacttaaaatgtaatcatttgatagcattctatttcatgtgcagttaagagaagatgcagctttctctcctggcaatgcagaagttatgctaaaactaattatgcagcaatgattttccagttgaatgatttgggtgaagaattttgcttcacttacagatttctatttaatgagaagcttgcaatgaaatattgaaatttaagctgtgcctgtttgtttacctgaatcatagactctgccaaccgtgtttcatctacttccaatatcatcattctgatttcctcatatggcacccgaaaagagctcaggaagattgctaagaaggagaaagagagaaaggtttataatgaataaggtttaaaaaagtatttcagatgtagttctatttataaaatcaaaaataaattcataaaacaagagaattcaaacatttaatattatgtttgggggaaacatattatgggggaaactttcattactacattttatactcttctctagttttagaactagtgtttaaacaacagtcctgtgttattgcactggatccaaggttgatttttaaatgctcagttatttatctaccataggaatgatgtcaattttcatgtgataacaaaaaatgaaataaggtacactataaaaacatcacattgtaatgaaaataataagaaaaccacagtatgtgcatgtaatatttgtctaagcatatgtattatttgcttgtatctcttctagccttaggaaagagttcaggaaaaagtattttaagaaaactgctaagcagtacattaacacttttacaagtaatagtagcacttcactattcagaaacattgtaaacagtatgctagggaaaccttcacatgtaaccaaagcttaaaatatccagttttagaaaacaaattctcactgaaaattatccaaatgtactagatagtataatatgttattactgagaattctaaacatctttcttgatggctcttatatcaactattataatgattttttcaaaagttactgaagtagaaggatattttcacagcaacagatacaacgcttttgctagttcaacccttattgtactattatgtttttacattcaagatgtcacttcttaaccatactcagcacctgcaaatcaatagcctattatttttctttttatttaatgaatttctatgtcatctggtatgtgtatttctagataaagaaactatgttcagcacctcatatctgtgggttccatattcacaaatctgaccaactgtggatcaaattcaatccacagtaggttgaatctaaagatacagaaaccatggatataaaagcagaatataaggaacttgagcatctgtggattttggtattcatcaggggtcctggaaccaatccctctgatatcaaaggatgactattttttataaaactcaggaaacaggatctacttcttttctgtattgaggttgtattcctgatttgtgagaatatcatgtatcacctacagattaacaagggcatcatctgtattcatatcaccaacacacacagttctgaacccaagaagtcttaaatatgaaatcattacaataaaactcacagatgtctataatccttaatatcccaagaacaagatgaaatatgtaaatggtataagagtaaatagagatttggccaggcacggtggctcacgcctgtaatcccagcactttgggaggcagaggcaggcggatcacgaggtcagcagatcgagatcatcttaactaacatggggaaactccacctctactaaaaatacaaaaaattagccaggtatggtggcatgtgcctgtagtcccagctactcgggaggctgaagcagaagtattgcttgaaactaagaggcagaggttgcagtgagccaagattgcaccactgcactccagcctgggcgacagagtaagactctgtctcaaaaaaaaaaaaaaaaaaaaaaaaaaaagtaagtagaaatttataaaattacaaaagacaactccgtagtagacaatagaacatgcaaaaaatataatcactgaagatggtgaagtagggctctccagtaattctccaccctcacagaaacatgaatttgaactagccacatgtgaaagaaaataccttcaaaagagagaaaacaagtgaaaaatcacagtacctggtatagactaatactaaaaaagatacattgattatgtaaagaatgttttacatcacccgtatcaatccatccaccaacgtcaggcagcacaggaaaaaaaaaaaaaaaagagagagagagagagatactgtccacttgaaaaaaaagagaagtgaacatagaaatttccctttgtcgctaacaacaaatctaccagtataaaatgctcatggactctgattcctgacaggtatctgcagtctaagcatctagactgacactggtaccagacaggaatctaacggtcctttgagaaaagactcgagttctggcctatatcactgacggatgactgcagcgaccttcgtttacagaaaatactcagtggcaaacaggcaacagaagccatgggcttcaggaaccacccaggactgcaacaacattaagaaccacgaaagtaagcctgatgcagggccagctgtgggagccaaaaatttccagcctgggctgcaccacccaaagcacttctaggcttagggcactccctaacactgcaccaacaacagcaacccataccagatggtctactcaaaaaccctagacagacttactgttgaaagatgacctaaaataaagtcacactgagaagaatggaataaatatctacttcttcaacatgcagacagcaacacttgaccacaatgcaaaaagacaatcagggaaacatgacatcaccaaagggacaaaatcagctgccagtgatgtacactagagatggacatgtatgaactatctggcaaggaattcaaagctgtggtttaagaaagttcagtgaacttcaagaaaatacaaaaaaaaaaaaaaaaaatcagtattttttaacaaagaaaacagtttttaaaaattaaacagaaatactaaaatatacaaggtacaaaatgagaaattcagtagagagcatcaactgtacaagtgatcaagcagaagaaaaaaatctgtaaacttaaagacagtttatttaaaaatatactgtaagagaataagaaaaatgaatgaaaaggaatgaagaaaacgtgaaatttattggacagcattaaagagcaaaaacgtgtcattgaggtttgagagagtagataacattgtagaaaacttattttaaaaagtaatagcagaaaactttccaaacctgcaaaaagatataaatatccagatacgggaaggtaaaaggtgtctagtatgattgaatccaatactacaccatgacattataatcaaactgtcaaagatcaaagacaaagaggggatccagaaagcaacaagagaaaataataaaatagcatacaagagagttccagtatacctaacagcagacttctcaacagaaaccttacatgccaggagaaaatatgatgacatattcaaagtgctgaagaaaaacaacttctaagaatactttaccgtcaaaatttatttttcagaaatcaaggagagatagagtttcccagacaaacagaagctaaggaagttcacaatcaacagccctgtcttataaaaattgctaaatgaaattctgccagttgaaagaaaaggatgataatgagaaacataaaaatatctgaaagtataactcaccagtaaaagtaagtacatagtcaaattccgaatattctaataatgtaatagtggtatgtaaatcacttgtatctttaaaagggagaatagaggacaaaactattaaaattaatagtaactacaataaattgttaaggaatattcaatatggaaagatgtgagttgtgacatcaaaaattcaaaattcaaggaaagagtaaaattaatatgtagttttattttttataagtgatcaagtttatcagtttcaaataaattgttgtaactgtaaaaaatcttttagttagcctcataaccacaaagcaaaaatctatactaaatgtactacaaattaaaagcaaaaaaatcaaaacatactattagagaataatcacttatccagaaaggaaaactgtaatagaggaagaaagtaaaaaggatctacaaaacaactagaaaacaatcaacaaaacggtagttataagtccttcactatcaataattatctagcatctaaatggactgaattctcaaattaaaagacagagtggctgaatgaaaacaaaacaaaactacaactatatgctgactattgaagactaacttcacccgtaaagacacatataaaccaagtgtaaagatagaaaaagatatgccatgcacatgaaaaccgaaaaagaacaggagtagctatatttacatcagataaaatatactttaaaccaaaaactgtaaaaggagacaaaggatattacataataaagtgatcaattcagcaaaaggatgtaacacttgtaaacatatatatgtgtatatgcatgtgtgtgcgtgtatatacatatatatgtatatatatatataatttgtatccaacaccaaagcatctaaatatacaaagaaaatagatctacagggagacatacattgcaatacaatattaggagacttcaatgcctcattttcagcaataaaacagtcatctagacagaaaatcaacaaacatgaactagaaaatgaactctaggccaaaaggacctaacagatatttacagaacatttcatataacaaaatcagaataaacatccttctctcaactgcacatggaacattctccaggacagatcatatgttatgccacaaaacatgtcttaacaaatttaaggagactagaatcatatcaagtatattttctgaccacaatggaataaaactagaaatcagtacagaagaaaattcaaaaacttttcaaatgcatgaaaactaaacaacatgcttctaaataaccaatgggtcaatgaagaaattaaaagtcttcaatataaaaatgtatttagaaaattgaaaagggaaacacaacataccaaaatatatgggatatagcaaaagcagatctaagtgagaagtttacagaaataaatgtctacactaaaaaaaaaaaaatctcaaacaacctaacattgcacctggaggaattagaaaaacaagacaaactcaacccaaaattagtagaagcaagaaaatattaaagatccaagcagaaataaatgaaatggagaccagaaaataccaaaaaaaaaaaagaaagaaaaaacaaccaaaaatttcatttttggaaaaaataaaataatcaaatgtttatttagactaagaaaactcaaataaatatagtcataaatgaaaagatattacaactgacaccacaaaaataaaaaaagaattatatgagactattttgaataatttcttatacatcaataaattggataacctagaaaaaaaatggataaaatcctagaaacttataacttaccaagattgaattataaaacaatacaatacctgaataaaccaataaccagtaaggaaactgaaattagtaataagtagtttcccaccaaagaaaagctgaggatctaatacatttgctgcttaattctatcaaacatgtaagtaaaaactattaccaattcttatcacactattcaaaaaaaatcaaagagtagagaatactgccaaactcactccacaaggctggcattcccctgaaaccaaaacctgcaagaatgcaacaaaggaaagctacttgtcaataaccctgaagcaaaaattctcaacaaaatgaattcaatacatgaaaaagatcattcaccatgattaaatgggattcattccagagatgcaaggatggttcaaaacatgcaaatcagtaaatgtgacacaccctattaacagcatggaagacaaaaccatataatcatttcaatagatagaaaaataatttgacagaattcatcattcttttatgataaagaattttaacaaattaggtatagaagaaatgtgtcacaacacaataaatatatgcgttatatatgacaaacatacagctatcatcataacaaacagaaaagttgaaagcttttcctataaaatctggaagaagataaggatctccactttcaccacttctattcaacatattacttgaagtcctagccagggcaattaggtaagagaaaaaaaataggcagaaataagttaagctgtacttgcttgcagaaaacaaccttaaatataaaaaatcataaacaaatgaaacttataaaactcctaagccttctcttgatcctagtgtctggaaacctttatgaactcaaaaatataggaaaccaaaaccacttttaaatagacaagtagataaatgaatgacttttagattctttctccaaagttctaatctagtacatacccataatattctcttcaatgaactttagaaatgaacctttccattttagtatcagtattctactactgaccactgttttatttcaatttatctcattccaaaacagttctaagactcatctcagaattcagactctcaaaactctaaatttcatgacaaaaaactataattacaatgaagatcataggctgctaaagcttcttaaagcttaaatcataatgcctgctaccatcagagaggagaagaataatcttaaaatggattacatcataatatgacatggtataaattctgtatcttttcatcttacactttaaaacatgtttctcaattaaatgaataggatatatatactctagctaaattaaacaaggcaaacaggatctttctccataaaaatgttattctgttttctgtaaaaaggaacagatatacattaaactatataaacattaaaatattttcaaaatgagcaatcttattgaaatcacttaactgctacacccaccagattccctacctatactgttaatgctaatacccacctggtggggttgtagtgaagattaaagggccaaatacagaactagtaaacaaaggtaatcagtatttattagctgttttaattaaatttgaaatcccatgtagaacatgttctgtaatacataaataaataaccgtgttcaaaaagttatttaactatgagatggacatttaggctaacttaccacagctgacccattcagaaagaattctattaaacattatatttcttcgggaactattacaagactatttagaatcaacactagtaatttgtaatgcaggtcatgaacatttttcaaaataaaatcatctcttttagatcacagatacggaactttctgacattatctgacatagttcaaaacacagtgctttgaacctagacaaagttcttttgggagggaaattccctaaaatatgtacatcatgcaaaaaacaaaaaacacaaaatctctgtggtctaagcaaacacacacaaattatttctcatgaagaccatatgttcatcacaccagtttctgttaattattaattatgatccctatatcaggatgatggacaccactctgaatgccattctgggtgccagggggagcttcttcaaccaccaatgaaatgcttccaccccaaaaagtgacattaactccactcccatcttcactggtccaagcatgtcacttggtgactcctaacttgacaggggcagagatgtgcaatcagcagtgcccagaaatagagaattgaatactagacaatacaccaatgccgccatactatccatggggatcttggcaggcctgcattgtagaaaagagatgggtttagatcaaagtgattacgaaggagaggaggttctgaaattttcataaaaggaatgccaactctaccatttgaatatattgcctctaacataactctctctttaatcagtagcatggatctttatcctctcgctgaagaactgttttattccaatacttgctaaaagctcagttgaggcatgtaataattgagggagactaaaaaccatgttaattcttcatcactctagattctccccattattcatatccctcttgcaccatcagaaagtgatatatacagaccatagtatatcatctctaagcataactacctttgatgcatttagagtagttagaaatgagttaagagcaaaactatttgccttcttctctcacagtaatttggtcaagaagataatttaatactgagtatttagctcctgtaacagtaattaaatctaaaatatttctactcagaacttttgaggaaaggctttgaactgctcagatgggataactgaattcactttactcaccatccttatttccgttaatattataacctcctttatgtgtgatcaagtatcacaaatattagagattcagagttataaaagaagcaatacactaccaatttttttcaaaatatgatgtcattacctaaattccttaagtctttatttttatactttaaaaaaagggactttaaagagtagctgtttttttttttcagttatgaaaggtagaatttcattttaaaacctcttcttatttgtattttctaatatgcacttatcttttgaagcatttaatcccataatttacctaaaggagagttatctgtgaatttatcatgcatataataacaaaatgaaaatagcaaataatgaataatcggtcttaaagaaaatgaaatcatttaaagaaatatttccactgtctttgaatggtattggaatatgatacttacaaaggttctgggcaattttagaatctaaaaacttaagttctttaatttttttcttaatcgatttcttctcttcaatatcttcctcttctcttctctctgtaaaaccaagatagatccatgttaggggcagcaattcattcaaatacaaaagtggaaaaagtgaactttttatcattaaataagctaaaaaggatgtaactcttctaaataaaagttataaaaacaaataaaacgatagatatcccaagacctgaactgttgaagatagaaactgggagcttttatgccagagaaactatggaaagtaaatatttgaaggtctaacaggaaaaacaaaaataaaacttatgtatactatggaaaccaataccaatgggtataagaataactacaattagctcatttgaatagcatacaggatacagttataaaaattaaaacacctgcactcaagttgcaagtatattaattggattatgaagctagctctaagaatgctaactaaaacagtcattttatgtctaatatacaataccattcttatttaaaaacataccttatgaaaaattaacagaataaattttattgatcgtgaatgttgaatcatctatgcatccttgaaataaatcccatttgatcatactgtattatcttcgtgatgtactattggatttgttttgctactattttgttgaggatttctgcatctaaattcatcaggaatattggtctaagttttctttttatgttgggtcctcgtcttgtcttggtattagtgtaaagctggccttgtagcatgagttaggaagaattctctcctcttcatatttttggaatagtttgaaaggaattggtgttagttcttccttaaaaccttggtagaattcaacagtgaagccatccagtcttgttggaagactgatcaacttccttactcattattggtctgctcaggtttcctattctttctgatttaatcttggtagctacgtgtccagaaatttcttcatttcttctaggttttccaatgtgttggcaaacatttgttcataattagactctaacaatcctttttatttctgtggtatcagttgtaatatctccttttttgattttgattttattcatttgggttttctctttttcttctaatggtttatcaatttaatttaaaaataaaacaacttttcatttgtttaatctcatattgtttgttttttgtttgttttgagacagggtctcactctgtcacccaggctggagtgcagcagcataatcacagctcactgcaaccttgacttctcaggctcaattgatcctcccacctcagcctcccgtgtaactgggactacagatgtgtgccaccacattcagctaatttctttttatttttcatagagacagagccccactatattgcccaggctcgtcttgaactcctgccctcaagtgatcctcccacctcagcctcccaaagtgctaagattacaggtgtgagccacctcacccagcaatgtgtcttctttttttatctgtttcatttagttctgctctgaactttattatttctttccttctactaactttgggtttggtttgttgttttcctagttccttgaaatacatcactaagttcttgatttgaaatctattttttatgtaggcattttttgctacaaacttccctcctagtactgtttgtgctatattctaaaggttttggtatattttgtttctactttaactcatttcagaaatattttttattttcttaatttcttcataacatattggacattgagactaattgtctaactggacattagagaagcaagctgtataatttccatattatttgtaaagttcccaaagttcctgttgttgatttctagtgttactccattgtgagctacaaagatacttaatataattttgattttttacaagttgttgagacttgttttctggcctaacatatggtctattctggagagtgttccatgagctgaagagaagatgtgtgttgtgcacctactggatgctatgttctgtaaatgtctattagattcatttggtctacagtgcagtttcagattgatagttctttgacaattttctccctagatggtctgacaaatgctgaaagttaaattctccaactacaactatattggagtgtctctctccttgtagatataataatatctgctttaaaaatctgggtgttctggcgctgggcattcacacatttaaaactgttatattctcatgctgaattggtccctttatcattatataatgatcttgtctctttttatctctttttgacaaagtctgttttgactgatacaagtatagcttatccctgcacactttgacttttcatttacatacattacattttttcaatccctttgctttcagtcactgtttatctttacaggtgaagtgagttattgtagacagcatatatttgcatcccatttttttaatccattcagccagtacataactttcaattagagaatttacactacttataatcaaggtcattaatgggttagcacttacttctgtcattttgttgatcattttctaattgttttgtatatcctttgtttctctcttcctctctgtttatctttgtagtttggtggttttctgtaataacaatatttgcatcctttctcatttgtgtgtctgctctatagggagctttttacttttatgtgttttaacagtggtagatacagctttcttttgcttccagatatatgactcccttaagcagggagtctagcagtgatgaattccctcagtgtttgattggctgggaaagactatttctccctcacctgtgaagaacagctatactgagtaaagcattcttacctgacagttattttctttaagcattttgtaggtatcatccaattctctcctagtctgtaaattttctgctaaaaaaaattgatgttggtctgatgggcattctcttatatgtgacttgacacttttctcttgctatttttataaatcactctttgcctttgccttttgaaaatatgaatataatatgtctcacagaagagtttttgagttgaatctatttgggaatctttgagcttcgtgtatctggatgtctatttctttcccaagacttagagagttttcagctattatttcattaaataggttgtctatgccttttcccatctcttctccttccagtaatcccaaaacacaaatatatatttgcttaattttatcccacatgtcacgcagactttttaaatctttttctctatttttctttttttggtttgtctgggttatttcaagaaacctatcttcaaactcagaaattatttcttgtccttgtctagtctactgatgaaggtcttgattatattttttatttcctttattgaattatttgattcaagaatttctatttggctctttttttatatctatctctttgttgaatttctcattctaatcaattgttttcctgatttctttatattgtctacttgtgttctctgcgcttcactgagtttccttacaatcattattttgaattccctttcaggtcttttataaatttctttttatttggggtgtgttatgggagaattactatgttcctttgaggtatcatgtttcctttctttttcagatttttttgtgtgtccctaaagtgatatctgtgcacctcctctaataatcacttctaattttatagagtagctttaataagctaagactttttcctgcagatgtatttacagcatcgattaagtagagtgtttggagttttgggtgggagcagccacatagtctctgtgtgatttcttcagctataatcatcagcagtgtctgagatttcctcagtggcttaggctgcagttgtttgtggaggctttggtatgactttcatagtgatgaagatgaagagccaaacccaaggtgggtctgtccttgagcccaagtggcatgtatatggataccagcaggccctagtcacatcagtccttcatccccggggcagcaaacataggttctgggaagactagtccttgggcccctgggggttgtacttggggaatggcagtaacagtcaggtggcacatgtgatcgtatggcagtcccacactggaggtggcgaggtcgctattggacaaaattgggaacttgataagaaagaagagtgtagcaatgtgttttggtagatatgtaaatcactaaaggtaaagttcaaaatctgaaatgctccaaaatctgaaactttgagtatcaagatgacactcaaaggttatgttcaaaggaaatgttcattggagcatttcagattagagagatttggattagaggtgctcaacccgtaagtattatgcaaacattccaaaatctaaaatacaaaacacttctggtccaaagcatttcagataagggatattcaacctgtatattacaattatatattttggtacatagcatgaggtaagaatcaaattttccatttttcaaaacatttgatatttctgtgtcattttatataattaaccatctttctcaactgattttaagttacactttgatcatataattagtgtctagataagttatttctatttttctgggctactagttctgctacattattctctgtgctactgttaacactgctatcaccctgtcttaagtactatagatttatgatacgttttattcattggctgttcaaattatttttctccatatctaaattttgttcttttttttttttttttttttttttttgagatagagtcttgctctgtcgcccaggccagagtgcagcggtgtgatctcggctcactgcaacctccgcctcccaggttcaagcaattctcctgcctcggcctcctgagtagctgggatttacaggctcatgccattatgcccagctaatttttgtattttttttttttagtagagacagggtttcaccatgttgaccaggttagtctcaaactcctgacctcaagtgatccaccggcctcagcctcccaaagtgttgggattacaggtgtgagccaccatgcccggccctcatttatttctccacatgaactttagagcaatccaaaaggtctaaaaataaaatccatttgaactgtatttgaattgcaaggtaattgcaaatagattctgagagatttaatatcttgacaatttctgaacttccttatcataaacatggcatgtgtttataattattcaacttagcacagtgttcttcatacatgacctgtatattttatgttaagtgttaggtatccaaaggacatttgtactcctaggtattgtgtagaaactttgcctaattttgtatacatgttttataatcaggattttacttattttgtctttcattcagataaaaaaaattattaagcaactaaaaagagactgtgttaggcaacaaagatacaatgctagacaagatagagaaattccttgcctcaaagaatttaaggtctaatagaagtgactataaaataaatgacaattataatacatggatgtattagtgatgttatagtgaaaactacacaagaataaagaagagcaccctaactatgcttgtcaaaaataatccttttgggataaatacctaagcaaagcttgaaaggaaaaatgagtcagccaggtaagaaggtgggggtatgtgggaaagacacaacaatagaagaatagtatttgaaggtgtaaaggtgcaaaaactctaaaggcactgaaagacttgaagataataagaacagaaaatattaaacagaaataaatgacaccagaaatgagtcaggtaccagatcacataagatattttaagccaggctaagacatttggattttattctcacactaatgaggagccactgaagatttaagcacatgagacatcaggataactatattttaggaaaaactcaggctaaagaaggtggattagaagaatggcaaaaattacaatagaagggcaagactgaaggaagttacagtaatccaaacgaaagtcaatggtaccttcaccaagggcaataacaacagggaaggagagtgtggatgagttccaaaagttgattctgtagtgggaaatagactaattattgatccagcccaaatttgtctcttgaactccagacttgaataaccaactgctccctctcaacatctttatttggatgtctaatgagcacctgtacttaacatgcccaaaagcaaactcctgacatatacgtgcctacctccatatctgctctcccaactattttcttcagcttaaaaaatgggaatgttctttttgctattttcaagtcaaacgcttgaattttgctactattcccctcacgataatatcctatccatcagtgaatctagtcgattctaactccaaaatattcactaaagtaatcactcctcaccattgccctggctacaatttctctttttgtggccaacatattttttcacctggaccacagccggtttctaactagtctccttgctttcaggcttgactagctgtagtctctccactacagtgcagcaaatgaatcctgttaaaaacttagtggcaaagccttcccttactgccttatatagaaagcaaactcttcacctggtgttctctatcaccattgttctgacttttttctccttcaaagcacttactccttacatatcataaatttgatattgtccctcttcctccattagaagataagatccttagaggcagaaactttgattgtcactatattcttagcaccaggattaaagcctggaacacatcaggtgctcaacaaatatcttttggatggacatacatgtggtcacttgtgtgtatgtatgtatgaattggcagagtaaaagagaataaagaggatactcaggcttaagcaatcagatagatgataatgatgatgtttatttagataaacgatggtgatgtttatttaattcagcaacagttgaggaacaggtttggactagtccagtttaaaacatgttcagttacagaagctcttgtatatccacattagtcatgtacaagaggcagctggacatacagatgtggagaagagaaaatgggaatgatgatacaggtatcaatcctagtaactactccactaactgtcacaggttttccagataccatataacaacactttcatctccttattcccagaatttaaaacttgtttctggtcttgttgtattagttaaaattttcagatgaaggctaataaaaaagttagtaggattcccttccttaacctgaccaaatagcaatcctcaacttctcagaaaatgtatacattttattttcttgtctttattcttaagagcagactgtaactttttaaaatgtttacttttctcatcattatcagtatccttttacattctgaaacatttcgtagtctacctaaagaaaaacgtcaaagacacaagtaaccgtaaattttaaatcacatttactgaacccctattaagtactgcactgaaggctttctgtttccgtttcttatataattctcattatagtcatcctaatactactactagtatcattgtcatcatcatcatcacaataaggaaaaataacgcttagggtaattttaagcaataaatctgataaaagaatgatgaccacctgacttggactccaatattcttttcactatctatgaagtatgttaggtgtcacagtttaaaaaaaaacaaatacaagcaaccttcaccacttcaacctccaaataagacactgatataatttaaccaattctaccttttgaaaataaaaatgacaaattagactcacttaatttaatgtatcagcatactcaggatggtgagtatatacccagtaaggtaatcctcttctaccatcttcactgctatcatatagtcataggattgttgggacaaaggatcaatggaacttagatagtgagaatatggacaaagggatacaaagaagcagaactgcctaagagagaaaacaacagaaattttaaaaccaaaagagaaatacttttttgttgatatgaagccagataatgagtctattatacaaaaagattgatttggaaaaatctttcatattgagagataacaaaagttttgtttgttttttattttttaatgcaatcagggctgcatcagtggaaaaccagcaaaaatgttttatgcaaagaccactgataaagccgcacataaatgttggcaacaataaggatgaattaaaaacaaatgagaataaaggaggacatttagtgagaatgaagtttttgtacaaaatactatttctgctagccatgctggcaatacctctggtaaaatactagcatgcctggaggaagggcagggtcctctgtctgggaactcaggcctggaatcctgacaacaggttctacatcccagcctgccacatgctagtagctaaacctcattatggctgtgattgctcacctatgatatagggatactggccctctatgagtagttgtgaaaatgaaatgagatgataaataccttcatgtaaccctccccctgtggtgacaaagaagagtacgatcagagtccataaacacaatttagcattcaagagtaaagcacacttcaggctcaaacccatgaatcggtggagctactcttctaaagccagtacaaaatacacttactctgaaagactagattttctcaaatataacatgaaactctgaatcataaagtcagattattagtgccatctatacttgtgatctagctttgttgccattagagttttgtgtttaatcttacttcctagagatgctgtgtaaggctccatttttccaagagaagattaataccgttcaaaaactgttctgatcactaacacagcatatgcagcattttataagggttttatgtcagaatgaagtcaaagatgacaaaagttcctatgttgccaagagccatgaactgaaaaagtctcttttaattacattttctcttcattctttttctattttcaaagtttcaaaaatagtagcaaaattatgtaaagaatatcatttcaaaatcctttctttcatactaaattttccatttaaaaatcataattccatgtcacatggttatacatattattccagttcattttccattatgtactaatcagattgattaaaaatatagctttttaggagtaagatttcatataaatgttatcatacattatttcaccattgcaaaagaaaaaacacctcagaatatgcagtcttaaatgttttagtagtcagtataggcataaaaggtaataaaaaccagttttctctttctataactgagtattttaaatcagtaaatgttactaataagtgtttactctgcttttgttggtgctccctggttaaatgtatcttatgacaataggcacttaaaatattaagccttttaagtttttttctggtatgcctttagcatagatattattaaattttacatgttaatgtttataataaattacctttctaaatagactgtaattacactagccttaagagtatgaaaataagtatatctgaataaataagcaagcattcttctctatgacacagagagaagataataaattcaactcaactaaaaaaataaagtaagcaaaataatttacctagaaaatgaaaaacaccagtccctgacagtcttcaaatggggagatatctatgaattacttgcataatggctgttatttttctttgccttctaactcatgagattctaagaggctgataaagagtatcaaaatttgaaagatacaaatttttgaaccagaacggcccttcagtatggactttaaccacctcattctataaatcaggaaacctaagcagagaatataagctacatgctgaaggtggcacaaggcttggctatgagcagacctgagaccaggaactgaccaccacacagcaagcctagagcatcctctgggacatggaatttgcatgaggaaagcagtctgcaaccaagcacattagaaaggataactccccacactttgcatttacacttgatccaaattttcccttgctgtacatgttcaccaggacagttagtggaaactgaataggcctgagggagggaagagaaatgtttagtctccagaacacaataaacaggatttaaagctttgggaaataactacacagttgactcttgaacaacacgtgcttgcactgcacaggtacacttatatgcaggtatttttcaataaatgtagtcagttttccatattgacagactcccatttgcaaccaaacacagactgaaactacagtattctcaagaagcaaagcctgtggatatgcaaggtcaactgcaggctgggcagaaccaactttaggacttgagtatgtgtggattttagtatctgttgggttcctggaaataatcccctgcaaatacagaaggatgactctggttccaaaggaaaagtcaagaatgcgcctatcactacctctcaagtagtgggtaactttgctttggatagggttcagttattcagcaatatagtagaatggaatacacttgataaacttaaaggtcagaaatggagaataggcaaacgactgagaaaaaaactaaatttctgagagttaacaatataggtggttgataggacaatatggtttcaaagaaggtttaggtagctcaaaagcaaatgatacagaatacataggaaaaaaagtcaaaaaatttggaatgtttttatgagatggcaatagaccgttgggaaaatatcgaagtaaatgctttggtattgaaaatcacattgtataaatcactttagtcatatctggcttcccaaaccaagttttaatatttctaggcacataaataaatgggtgtgtacctaactacatagaaaataatcagtggagaaacagataggctatttttctattcaaatactaatatatgactgccataactaatcaggatattttactagcaaaaagaagtctgtttgacaattcaaggctaagaattatataatatataggaagagtagctgaagccctaaataaaattttgtgaaacagattatttcaactgtagcaatcataaaaaatgtagcagataaatgcgtatttctctttctgtgacattctgttttagcagacaatgtcacaaaacaaacagtcttgaaggtcttttttctgcaagtcaagtcctacatggacaggaataagaatctcactacttaataaacccttcattatgggtatatctagattttttttagccatagtcatatgtacaaaagaactgttaaagtatcgggaaataccttgttaaaaaacttaaagtacatacctcaaaacaataaagatttttacaaaggctacctaaagaatgcttcccctacctctttaatcctatatgaaattaaaaatcaaaatatttcataaaaactgcttaatatccaaggaccttctaaattataataattagcaactttgctcatctcaaaagtacgacccctacaaaaagaaccattttattgaggtctccttgggtataatcaccccctcataaccaaagatttaactagcagaaaaacaagagttcaaatcaaataaaatattaacaccattcaaaataacagatgaaacaactttttaaattcacaagctgtggattagggagaaaaataatcctgaaaagttaagcctatctatcacatatatcttagtgttaactgggttcattacaatttgagatgagctctgactgaatagatctaaggactgagagaagaaagtaaaagatatcaggaaagagagttcaaaacccgactgaaggaaaactgaatcctgttctaacatcatctatcttggctcatcacaacttctccagaaaacatccataaatttttatgtgccctcaaaatctcaccaccataagaaatacttctagtatctggcccctgtgaattcttcttgaatgttggtgtttcccagtcatggaatcatacatgtatattcataaaaattaatttgtccagctgggcacggtggctcacgcctataatcccagcactttgggaggctgaggtgggcggatcatgaggtcaggagatcgagaccatcctggctaacatggtgaaaccccatctctactaaaaatacaaaaaattagctgggcgtggtggcgggttcctgttgtcgcagctactcgggaggctgaggcaggagaatggcttgaaaccgggaggcagagcttgcagtgagctgagattgcaccactgcactccagcctgggcaacagagcaagactccatctcaaaaaaaaaaaaacataataataataatttttccactatttttacgtataacattctctcatatgttctctgatggtagaaatatatctctgctagaataaattacaaaaccaactctgaaagttaatgtatgacatacgaagacatatacaaaagaaagtacaagagaggagaaaagtcatgagtgagaactcagtgtacattcctaatttagaagaactaaatccaaatgataacacaggtaattcaggatctctagcatggtgtcgaatggaaagagttgataaaccagcttactagtatttgtacacacaatgctaagcaacttgagactagaagaagtaacaatacattatattaacaaacagataaaaagcaatgccacattaaatcataggcagaccatcctggcatattcctggggaaaacagaacacaatcatcaaaacagccagagtgattatccaaaacttgatagaagagaagtgatctgacacaaaaatgaccattattccaaaatactgaaaaagaattgactgacagcaaaatggtcaagcttaagtagtagaattttacaataaacttacttctatatttgatgacagcatgcctataattttgtgatcttgttttgggaggtggggaggcaggggaggggacgggaagcaaaaaaagaaagaaaatgctttattgtgtggggaatggagtgtgggtgtgccagggtagaaaagaggaggagaaggtagagacaatacctaggtatttgttcaactgaactcaacttttattatctggactttctgatacgtagttatcctgtctctctctctctgcttttacgttcttgtttttgatagctcagttgggaattcaagtcacttgcccagtttctcagttattaaatctttatttctctgtgctctaagaataatgccccagttagcattccagatcattctggtctccaattggtctagctaattggagttccattatttgcctgatctgtgttctagaataaactattctgtgctagtttctgtccccacaatctcctgaatttggaatttttattaatctgggctgttaaaatttgtagttctatgttatcttaccttctggctggagcttgtgttgtgtacatcctatatagctatttataacacccggcttgcagtggcacaggcctgtaatctcagcactttgggaggccaaggctggagtattgcttgaggccaggatttcaagaccagcctgggcaacaaaatgagtactcatctccacaaaaaacgtaaaaattagctgggcatagtggtatgtacctgtagtgctagctactcaggaggatgaagtgggaggatcacttgtgcccaggagtttgaggctgcagtgagctaagatcatgccactgcattctagcctgggcaacagaggcagaccttgtttggaaaaaaaaaaaaaattaataaaatgcccagctcacatacagacctcttttccactgtaccatctaactgcaacccaaatgttccatatacacttccctagtagtataaggaggtgaggttaaaggaagactagcaggattcattttatattgtgattagaaaatgatatttttaaaaataatcttcctgagagagtagagaatggggagttagtgtttaatgggtacagagtatcagctggagaagataagttctaaagacggatggtactgatggatgcacaacgttagtgttgctaatgccacagaactgtacagttaaacatggttaaaacggtaaaattttgttatgtattcttaaccacaacatttaaaaatagaaaaaaatttctttatgaggcttgatttcaaatcactcattttaatttgacctcttgatttgaaaatttatgtaggaatcatgtagttaaaattttgctttgtcaaatgaagaacaaaaatctaagtggctgtaaaattaatcagaccaaactgggatcatttaaaatgtatacgttctttcccaagaggtgttcaaaggcagagttggtccttattcactgcacacctcaaacttatacattggtttgactatttatataatgatatagataatgctgttacaaaataacgatttctcttctacctctcacccagattacctctccaaattgtacaaagaatttcattcttgggcaattcagtgtttcaagaacctaatcgcatttctatttccttgaatacccagctctcagatttctaagcttatagtagcccatatcaattactccgtcattaaaggtgcatagtgataaagccagggcagacttttacatgaaaggaagatcttcatcttttcctacacagaaactgactctcttcagcttcttgttctttgtcgcataaagacaggtggcacatggataatgtatagaattagattctggaaaggaaacccaagccatccttatgcttaaaagcctcaaaccatttacccaggaccagagaccagggagatgtatttggaatattcagacaaaagccaagttaacaatgaaatggctctttatctaggtttgttgtggatccctgtatatacatattgacttatattgactaaggcaaagtcaccttttattttctagttaaacaatacatatgtatatgtatctacagggagaatgaggcgtgtgtgtgtgtgtgtgtgtgtgtgtgtgtgtgtgtatcactaaggaatcccacaggaaaaatggagagctaagccaagtcaggattcagaaatccctggatggtttataatccttcaagccccaacaaaaactccaaagaatataaaataagcaatactttcatccccttgccaatgtccatatttaaagttaggctacttataaaatgaaaatctcccaatgttttcgagcctgcccccactcccctaaacaatcttaccttcagtgtaacaaccaaatctgctattaaaaagaacgtacttaacagagctgtattgtgaaatggggagcgaggtaacctttcgttaatgggaatgcagtggcttaaattgtattagaaatctcactttaaactcaattactttacaattatgtttggccacctgacacttgggcagagaagaattaacatcttagtgaagaagaatctttacaagaactgaaatatcccttactgtaaactccccaacctaactaattaaaaactatctttaaatgcttcatgaaaatgtcagaaagtaaaagtttttgttcaaaagacatacaccaacaagccaacgcagaacagaacaatactaaacagaatacctctgacatccaggaacacctattaattgggactctggctcatgtcaaaatttctaatctctaaaatgtttgaataaatcatattcatatgcttaagactattttacttcatgttggaaacatcaaatctgtatttcatataatttcttgaatttctgtaagactcaaatcctttttttcccaattaaaatggacagtgggatattatctaatggacagtggaatatcatctaattaaaaaaaatctccaataagaaaccattatttccaataagaaaactaacccataagaggctaagggcctggcaaatgaaaatgaggactctggactctcattcttgtgctgatgccatcctggccattcaaagcctatctagcccatcagtagaaactgcaaatgtgatgacagaagaactaaatgaaattaaaagcagaatgactaagattcattctaccctgcagagaaagtagagccagataataattggagatgataactggagattaatatttttctttcctgaaatttgtccaatagccttgccatttcaggatcaatggcatttatttcctctggggagaaaagataaaccctagaataagaggtcattcctgagcactgagtataaaattagatttctgttaatatctacagtgagacaatagtcttgaaagctatgtggttcaattgcaaaagctggttacttacaggaaaaaaaattaatgcagtcacaaaacattcctttaactatataaaactgagaatagggccctactataaggagtggctaggaaggatgcagcacatgagaaaaggacagagtgtcagacatagggaagacacaaaagcccttcctgggccaagagagaactcgcaggggatcagaaggacaagatcagaattcatatacacctctggagggtgtgctctcttcctcctccctcatggtgcaaggctgaaggagagccacctggggagtaactccaaagaataactaaataactaaagagatattagagacccccagagcagagggtatttgtggccagcttcctgtctggacctccacaggaagaccgcctcacagaagcctctaccaatatggggcaagcgctagagacaaaaatagtgcatagtatgtttagacaagtgtgcttgtgacaatatcttgctttgtaagtggttaatgggagatgtaaaagcactaaaagagtcagcggacatattttcaaaaaatatttactacgttgcactagatttttcaagtaacaactgaaaaattctcattggatataaaatcccctgcaactcaattaggaaaaaaaatgtatactagcagcaaatatcatatttcatatttcaaagaataaggcagcaaagaaggatggcaaaaaaaatctatttcttcccaatatgtacatgcaaaggcccaaaggcattataacatataaaacacgtatttctattgacctatgtaataccttatctcaaattatcaaatttaacatcttatccccatacttagctcttttggcttagtttcccaaatactcataatgatttctcagcttttcacaagctgctccttctaagcctgaagaagatatatatgatttttcacttcatcaattacttccatcctcaaatttgagcaaatattcttcaggataaccattatacagatttccttcattacaaatgagtgtcccttttgatcacaggcaccatttggaataattaactatcaaatatattgctttctgaatggagtttattgaattaatgtaaccctgtgtatgtaatatacttgacaaaaatttctttcactttgaaaagctaaggtcatttctaagctgtaactttaaaaataaaacaaatgactcacagatcttgcaacaatttttttagattcatttatattgactaaggcaaagttgcctttttattttctagttaatacacatcaaaatatataaggatttcaaaaaaatctaaacatgctattccagctaattgccatattattctagatttgtcccccaggaaaagatattgactttttaaagttcattgtgaaacaattcaaacaatatagaagtacaatttttaaaaagtaaagtttccccacacattaatacaaatattccccaaaggaaactattgaaatgatagttattgttaacaaaagctactgctggtagccttctgaaaggctacacatataagtgtataagggtgtacataaacaaaaaagatgtatacacatgtatacaaatatacaattgaagggtttttttccttaattaaatgagctcataccatatacattattttgcattttacttgtttcacaaagcaataaacccagtgtaattttccatgttcatatgtctagatcaacaacatttgttttaacagcttcatagcatatcacctggtaccataatttggctacatataataatttagctattttccttattaatgagcatttaagttgtttataaatctttgctatcaatattactaaaatattcttgcatatttttccatatatatataagcatttgttgcatctacttttaactgtgccgatgtaataatctcgttctcttatgagaaaagacatatgatcaatttaacaccgttagcacatttcctcttctatcgagtctgaacaaaatgggctttctggtttttaaaaaaagtttattttggcagtttatttcttaatgtcaacgaagatcagcagtttcaaagaattgtagaatgttaagctaccaagaactcttattttatagatatgtaactaaggcctggagaattgatttctccaaggcacacagctacctagtggtagattcaagacaagaaatcggcttcctgcttctagaccactgttactgtaccacactccatttcctggggaaggacgaacacagacacacaggaccaagaaagccctgttagaacaataatagcaactggaaatgtaatagctctcaatatggagctcctctgagggcttccctgtcatgataaagaaaatcttaatctatttcgttcattcattcactcactcactccctcccaaatcactgagttaggctctctatagaagaatacagaaaagtcaaatgttaaggcttgctcataaagaatctcggttgaaattggaacaataagatgtgaagatgtgaagatctattggaacaataagatgtgaagatataaaattatacaataacataatcatttatataaagtgaaaagcattacagagttcaagcaaattctgatatttattctatcagaagcccagtaaaagtttattaaaaggatagtaaatttttcaatgaccaaaggctttgattggcctcaattatttgaggtctcactaatacttattaataataacaattactactatttccttgaggccaaccaagggaaaagatgatggaggctgggcacggtagctcatgcctgcaaacccagcactttgagaggtcaaggtggaaggatcacttgaggccaggagttcaagaccagcctgggcaacatggcaagaccatgtctctacaagaaaaattttaaaattagctgggcatactaactcatacttgtagtcccagctacttgagaggctgaggcaggaggatcccttgagcccaggaattcaaggttgcagtgtgtgataatcatgtcactgcactccagcctgggtgactgagcatgacactgtctcaaaaaaaaaaatgatggaggacttagaaagttaaaagaggcaataacatctcagtagatggaccaggaaaatcttcacaaagtaaatggtattacatgtaggccatgaatgattaacaggggacaaaactggaatgcattcctttcctctcttctctatgaagagctattttccaaatataaatatatgcatttgtatacatacagagaaagaagcaaactatggctctgaataagttttccatacagtgtagaagaaaatttgactaaaatatagatgaatccaaaagctttaggcatttgcagttttattttctggaagacaactggagaataggaacacttgtttcaaaaattatcacacataaccaatcttcacaaggaagcagaatcgtaaggactcaaatttggaaagaaaaattgatagatttgacttctactgctacccataccttgtgtacaatgggatttttgatagtttgtttaaatatatacatttattattaatgcatagttgaattaaaaactactatgtttaacactaacttgtttctagcaacttttctgtgtgttagaaaaaaagggggggggctattatcctttatacctccttttagaaccttttagaaaggagagaggcaaaacatgtggaaagaacttgcccttagtaatcaatctttccaggctcataactggccactaactaacttgtaacaccaccactccctcttgcgggccagcaacaccatcatcaacatctacataactatgccctaagctaggggtatttcaatattgtaccaatgcttcctttgcccctaccactcctactgctggattggccctcaccttcctccctgctttcaaaaatcatatactcatgcttcaaaacaactcaaatgtttctttgaagattttccaaaaaatccacacctcaaatctcatctcctgcccttgtctccagtcacactaaacttctgatggatcctagatcacagattctttccaatctgaggaccttccatgactatcctctctaaacacacccctcatcataccttgctcatttactttcatagcacattcaaaaactacagtcatttttgttggcctatttattttctgtcttctccattagattatatactataggaaagcaagaagttatctgctcagcactgtatcccaggagctaggacagtacctttcatgggagaggcatccaatgttatttgctgcttggctgaataactgttcagctggctgcatgatttgccatgatggacccagtaaccaaaacgagagccctgcttactgatagcagatagctgcaatcctaggcatagtactaagtagcagctagccttgagggaatatgacttgtatatccaatttcacttgctgacagaaaaaaaaaaaaagccacactagcactaagacttaagcacttaatacaataggaatcacagagctctgagaagaaatagtccttaagcacaaagctgctgggctaggaaatagggaggccctcttccacagaggaatattgacatgagaaccagggtcaagaggtacaggtgagtatttctgtcctgtttccttcatgactcaaggttaatttacaagtattttccataacaattataattttaccaaaaaaagattaaaaatctatgaattaaaatttaaatgaaagcttcacatattaaaaatatgcttacgaagaaaaaatgaagacgaacactctggcttattactgaaagcttatacattaagtaggcagtgagttacagagagctgtctccatagtggacataaaaaataagaaaatatttctcaatgatcaacaaataacccaaatatgtcaaatgatatctctactggcaacacttttatggcttccatacttagcgctcagatttttttcatctattaaatgagaaaatgatagctatgatctagtaactttacaatcctatgatgattgaacaatcttccacttttttgtacttctgttacatgttgcaaagcattgtgttcctattatattgtcctttcagctaaaatggttaagtaaaaacaaatatttgcacaacattttacagtttacaaagcacagaatccagtttggatacaatgcaccaagttcaagattattaatgatggggaaagtgatgagagaaaaaaacctcccgaacactacctgataccattctttacattgttcatttcttccaaaaaaagagaagtatttgaagtttatgctcaatagatagcatatgaaacacaatgttcacaacaataaattttaaaagttcctaaagagtatatagacagctaatttgaagtagcacacaaataaacaaatgctaaaaaagcacttgagtcatttaaaatacatgcaaacacacaaagagaaacaaacatgttgctgatgagtactggcccatgcttacctacttagacagctattgtgtacaatattttaattcaatcatacttaaaattgcaaagttattcttctaaaaatgtaagtacataacggatatgttattttttttaactataccaccactgccaggcacaactttaaaataaaatgtaatacaaaaatgagaacatttgaaaatctggtacgataagggaaaaaaactcttaagataaaatggatgctgaagtgttgagttgcacccaggggtcaacaacattgtgtctattattcagctgaaacacagaatttgcctttagataccattttaatgttaaatcaagaactgtcaatcagcaccatttgtttgtaatccctcatcagaacccattgcctcagtctgaacattcataggaaagaatgcagagggcatatctgcaaccacttaaccttcatcaaccaacattcatgcatgctcattaacatttttttcatcccactttcgagcatgacacagctcataccggaataataactcgctgataattgttctagacaacagctggacaggcagagtgcagaggtgaacattctcatagattatggggtactgtaatgcattacaattagtaaaagagtcacatgttcgtgttgaatagctttcaacagaagtgaaggaaatgtcattatcacaaacagcaatctcctctaactttaactctgcatggtccaccgcctgattctcttaacgctttcctattttgaaataaaccaatgaaaaacattgaccctgttactgtactatttcatgaaaagaagtaatatttttgatgtgttacaatcagacacgatctaaatttgtgatttaatttaaagacagaaaagcaggaggagggagaggaggaggaagagaagagtttcacatcttactaataacaattgttttgagcatgatggtgtacacctgtagacccagctactcaggaggctgaggtgggaggatcatcacttgagccccggatgcggaggatgcagtgaactgagatcatgccactgcactccagcctgggcaacagagcaagactctgtatttaaaaaaaaaaaacaaacaaaccacaatcgttttgcatgaagtcccataaaatcattatttattatttttgctttaaactgtcaattcagaaaaataaattaatatcactgaagaaatctggaatatcaataaaaaaggagtcctacatagggaagggaatttagaatccagtccaacatcctattcataacagctttgatagctacttctttgccataatgcaataaaaataaaatggaattaatatgataatgataatactagttgccatttttagagtaatgtgagtcaggtatcataccaggcactcaacagacacagtctcttaataatcctaaaagtagtattaactctctttttcagatgagaaaattaaagctaatctgaaagagactgaaaattcatcccaagtcaaaacattatggagacaggattccaaccaggtagtctgattccaaagccgatgcttttcacctggcttcatggttaatttccacattagaatcttgtttattttccattatttcatcccaattccttggctgtacaattctttgactctgtagaattagacctatttctagaaggtctttattccaagacatagcatttatacttccacattttctactctccttgtgtccaagaaacctgctcttaacactcagataatctctagtccctgtacgtctacctagtttccattacacttagtttttgttgttgttgtttttagagatggggtctcacttggtcaccaaggctgaagtgcagtggtgtgatcatagcttactgcagcttcaaaactcctggcctcaagtgatcttcctgccttggcctcccatgtagctagagctacaggcatgggtttatcaggcccagtgtgttttttcgtatatatgttgggtgtttgtttttgtttttgctatattgcccaagctggtcttaaactcctggtctcaagcaatcctcccaccttggcctcccaaagcactggggttgtaggtgtgagctacctcaccagcccatgctttagattttctaatcaaacttcttaatgtggttctttctacaccctttctctgccttgcttgacataaaaagaaagaaggaaggaaggaaggaaggaaggaaggaaggaaggaaggaaggaaggaaggaaggaaggaaggaaacttcaacaaatttcatttaaagatctaatttaaagatcttatacatgattcattaatcaggtagcatctcatctaaaaatgtagaaaagtgccacaataaactgagcagagatggttgattttatagctagagaaggggtaaagaaagcaggaagaaggaacaaaaaacagactggtcatttttgagttactttctttatagggttaaaacaggggacttccttatcatataggctcaggtaaaataggccccttctgattggctgctgcgaatctcctatttttcagaaaactggcacatgttaaagttcaatttgattaaatggcacctagcacaagtgactccattctggtttgatctggcatgttaaggccaagtgcaacagcttagtaaaagacaatggcctcccatgaattttgtttagcaacatttagtcacaaatatctgggagaggggaatcaagaaacctaatagatataacagtctatatctctagtcctacttgtgattggtgctccttgttgaaggaaatcacatcacctgcaatgggatctactataatttaataatataatctgaaataaaacctcagtaatataaccagggtcagcaaactatagccccatgggccaagaccagtttgctacctgttttaataaatgaagtataagaggaacacatatatgaccattagtttatatagagtctgtggctgctttcacactgcaatagcacagctgagtagctgtgacagagaccatatgacctacaaaaacaaaaatatttactattcagtcttgtatagaaaaatgtggccaacttataatctgtagtggagatccataacagtatcttgagtcaagcagataacaataaaacctatttatctttagcctaaaatctacagacaccagcttgattcactctataatcctaaatcatcccatgctctgctttcttcccaaaatctaccagctaatgattgtctaaacctcgtggatcacacttcctcaaagagcttttatagctaatgtactcccatggaagtaacctagattcataaattcatcaccaatgcccttggtaataaaagtagtctcttaattgacattccagtttctggactttacctactgcaacacagagctgtgtgatactaaggtgtcatgctaaaacatagattataatatgttatgtctccatttaaaactttgtgacaatataatattttaatttatttataaacgtgacagaagaaaatataaatgcctagattttgcatataaacctccctaatgtaaacacaactctttctaggttcatcttccagtgacattgtcccatatatatcttctcattctcaaacacagagcagtatatttcactgctgatctttagctcccaagcctacgtgtttccccaaacaccccagcagcacatgtttcagtgcctttgttcacactcttgacttcctctccttatttgtacgttcactcatccatccaacaagcttattaagcaatgataaacatcagacactgccctgagtaaaaggagtagagtaggcagaagacatagttcctaaccactcacacaactaagaattttagtagaattacaaaccagagctatgaatgaaaaataaagggcactgtggggttgaatcacaaaacctatgccaatctgagaagtcatagaaatcatttcccaaaggagatgacacataagccaagaaatgaagtatatgaggtgggcaaagtgaagctatctccttcatgatacttttctaattatcccaattaaaatcaacaggtttttaaatatacttaatagctgtgatataatgactaaatgtaatactatacgatcagtcaagatatgaaggctatttaatagcatgagaaatatgtggaaataactatatatatatattgttatttactctagcagtataaacactgctagaaaacaaaagttttgaaaagcttaaaggaaatttaaattctacgatgaaattgaatagtgtagtggagtttagggtggtatttttttctttcatcaattttctaaattttctgtaacataattattctataatgaataaattatggcagcttaggtaaacaagctttatataatcttaatgaaatacataagtaatgttttatgtgtacttaactattaagacactgatgaggtttggttgcatccccaaccaaatctcctattgtagttcccataatcctcatatgttgtggttgggacccagtgggaggtaactgaatcatgggggcagttaccctcatgctgttcttgtgatagtgagtgaattctcacaaggtctgatggttttataaaaggcattttccccacttcgctcagcacttcttcctgacatcatgtgaaggacgtgtttgcttccccttctgctatgattgtaagtttcctgagacctcccaggccatgctgaactgtgagtcaattaaaccactttcctttgtaaattaccctgtctcaggtatgtctttattagcagcgtgagaatgaactaatacagacatacataatactgtatactgtattacctataacacatatatctttcatgtaaaattgcaagcttctcagtcatatttatgaatcttctgccatcattcactcaataaacttcataattaaatactattttgatcttcatatttccctacttaaagactttattagtttctataataggcattaatatacttgattttctgttatgtcccatcaaacttttataaaagcatcactttcagtaaaattttgaggtttttaaagcttaaaatcaacacctataaaaaattaaaaataacaagtgtgggcaaggatgtggagaaattacaactcttatacattgctaataggaatgtaaaatgattcagctactgtggaaacagcttagcagttcctcaaatagctaaacatagaattaccaaataatacagcaattccaatccaaagtatttatccaaaagaattgaaaacaggtattcaaatacatgtacaccaatgttcacagcaacactatccacaatagccaaaaggcagaatcaccctaaatatccaccagtgaatgaatggataaatcatggtataaaactacaatggaatattattcaaccattaaaagaaacatagcactgacacatgctacaatgcatactcaaaaatattatgtaaagtgaaagccagatacggtaagtcacatattgtgtgattccactgatatgaaacatccagaacacataaatttataggcagaaaacagattggtgattgccaggggctaggggaagtgaataatggggagagactgcttaaggggtccagggttttactttggaatgatgaaaatgttttagaactagatagaggccgtactaaaagccacaattattcatagttaattttatgtgatattaagttttatcacaatttaacaaaaatcaacaccaaacaaaggagcaattttcaggaaaaatacctacaaaatgtgttagagtatgtttgctattaattgctcctggtttgtagacaccaatcagggtgcatccaacaacaacacagaatttacctataatttttactttcctccttcttactttttgctgctaaaacagaaggaaaaaaaaggtgaatcattttagcatctaggtcctgaacctattccactcccaaccaccttcattattctctgaatttttttaacctaatttacaagagtctgctattcactcagagctaaagtcatcagaggcagagttaattggaatctagatcatttaaatatttctactccccttccaaaatttccatttgcttaaaatgaaaaaagacagtttgcttgaggaggctgaaattattgcatttctgctttaaagaaatgaaaaagcattcatttatccagcaaacattcaatgcccatatgtgccaagcattcttctaggtgcttgtgatacatcagtaaatgaaacaaagagctctttagtaaaggagcttaaattccagtgggagtagggagagaataagacaacataccgaatatataagtagctaacagtatgttagaaggagataaatgacatgaaaactacaacacagtagagaaaatggggatggcgtgaggacaaaggaaaacatggcaggattaatttgggagttgagcatgggaacctcattgagaaagcgacatttgagttaagacttgaaggtggtaaggggctcatggagcacatatctggagcatgaatgttcctggcagggaaaagcccatggcaggagtatacctggcatatctggggtacatcatgaaggttgcccagtatggtagaagtgaaagaattgaaagagaggtaataggaaatgaagttggcaagccaaggagtgggagaataaaatgtttccagaagcttcagcattttccagatactgagaaaaaagggctcaactgtttgaaggtagaaagagaactacatggaatgtggaggacaggggcagaatccaggtgggctctccaatgcctggtgaaagacgtactctaagtcagtcagccacagctcccagaaggaaccaataggaattttggtaggagataaagaatgggtaaggattacaaattaaaacactcaaggataaatgatgaggacaaaaggaaggggcaatgaaatgcaaagccaaatttagagaaaaaggagaccaatgttactggagtaaacgatgtgtagagcagaaaagtaacaaggagaaaatagctagatacacaagttagacctgattgcagaaggctacaaatgccagactgagaagtcccttttctttttaatcttttcgtatgtgtgcatacaaagtatatgataaatgggatattcctcaggaccataaatctgaagatagtttgcattattgtctttaaaaaagaatatgaatagaaagagcaatttggaagctatttttttaaagaggtatttgaagaaagtatgtaataaatgaaaggctatcgctgtttctaagtgtcaagaaacaaaataaggcaaaataggagatgtaactgtgctgtataagtagtcagggttcctgacaccaaggtccattccataccaatgcataaggtccttcaagatgcacctagtatgctctcatgcctttccctccctcctgttctctaatgtctgtgaacaggatagagaggaaagaacaaaagttatgaagtcaaaaagtaaattcttgattttcaactcctttctaataatgcaaccttgacagacagagttttaacttttgagtctcaccctcttacattaaaataaggcaaaagcctaaattacaaatgtgaggactgggcaccatccctggggttattatgcaaggcactcatttttcctttaacttgtaagttacttcctttatctcattcccttttgcttctaacagctgctctggccttataaccccaatataatcaaaaataatgataaaatttgggttattatggttgtaggacatgcttattcatcaagaacacattcacaaaacaaccgtcttaataacggatacctcagagatacaaaagtggacaggggatgaccatgtcaggtggttagttgacttctctggattcaactctcttattaaataatataggtgtgtattagtccattctcacactgctataaagaactacctgagactgggtaatttataaaggaaaggggtttaattgactcatagttccataggctgtagagagggcatgactggggaggcctgaggaaatttatagtcacagcagaaggacaaaggggaagccagtacatcctatatgactgaagcaggaggaaaagggagtgaaggggaagtagctacacacttttaaacaaccagatctcatgagaactcaatcatgaggcagcactaaggggatggtgctgaaccattagaaaccacccacatgatccaatcacctcccactaggtcccatctccaacaccagaaattacaattcaacatgagatttgggtggggacatggagacaaaccatatcaaggtaataacaaatgaaataatccaacgattactcaactttagattttctggtttatggaatattctttcatatatatatatacatgtatatatatatatacatgtatatatacacacacacttttatatatatttgtatttgtatttgtacatatgtatttttatatatgaaaaattctattataaaactattactactgatatgctttggctgtgtccccaccaaaatctcatcttgaattctagctcccataatcccatcatgggagggacccagtgggaggtaatcgaatcatgggggcgggtttctcctgtgctgttgtcatgatagtgaataagtttcatgagagctgatatttttataaagggcagttcccctgcacacggtctcctgtctgccaccatgtaagacgtgcctttactcctccttcacattcctacatgattgtgaggccttcccagccatgtggaactgtaagttaattaaacttctttttctttatgaattacccagtctcgggtatatctttattagcagcatgagaagcgactaatacagtaaattggcactgcagagtgggcgctgctgtaaagatacccaaaaatgtggaagcgactttggaactggataacaggcagaggttggaacagtttggagggctcagaagaagacagaaaaatgtgggaaagtttggaccttcctagagacttggagggctcagaagacaggaagatgtgggaaagttcggaacttcctagagacttgttgaatggttttaaccaaaatgctgacagtaatattgacaataaactccaggctgaggtggtctcacatggaaatgaggaacttgttgagaactagaataaaggtgactcctgctatgttttatcaaagagactggcagcattttgcccttgccctagagttctgtggaactttgaaaatgagagagatgatttagagtatctggtggaagaaatttccaagcagcaaagcattcaagatgtgacttgggtgctgttaaaagcattcagttttattcattcagaagatatggtttcaaattggaacttatgtttaaaagggaagtagagcatagaagttcaaaaaatttgcagcctgatgatacaatagaaaagaaaactcattttctgaggagaaattcaaatcagctgcagaaatttgcataagtaatgaggagccaaatgttaatcaccaagccaatggggaaaatgtctccaaggcatgtcagaggtcttcatagcagccactcccatcataggcccggagacctagaagggaaaaatgatttcgtaggcgggccagggccttgctgctttatgcagtctcgggacttggtgccctgtgtcccagctgtagctaaaggggcaaaggtacagctcaggctgttgcatcagagggtgcaagccccaagccttggcggcttacacatggtgtcaggactgtgggtgcaaataagtcaagaactgaggtttgggaacctccacctagatttcagaggatgtatggaaatgccaggatgcccaggcagaggcatgctgcaggggcaaagccctcatggagagcctctgctagggcagtgtggaagggaaatgtggagtgggagcccccacacaaagtccccactagggcactgctgggtggagctgtgagaaggcagccactgtcctccagtccccagaatggtagatccactgacagcttgcaccatgcaccaggaaaacccacagacactcgacaccaccccatgaaagcagccaggagtagagatgtaccctgcaagaccacagaggcagagctgcccaagaccatgggaacacacctcttgcattagtgtgacctagatgtgagacatggagtcaaaggagataattttggagctttaagatttgactgcccagctggatttcagatttgcacggggcctgtagaccctttgatttggccaatttctcccatttggaatgggtgtatttacccgatgcatgtacccccattgtatctaggaagtaactaacttgcttttgattttacaggctcataggtggaaggaacttgccttgtctcagatgagattttggactgtgaacttttgagttaatgctgaaatgagttaagactttgggagactgttgggaagacatgattggttttgaaatgtgaggacgtgatatttgggagggaccaggggtggaatgatatggtttggctgtatctccacccaaatcttatcttgaattgtaactctcataatccccacgtgttgtgggagggacccagtgagaggtaatttaatcatgggggtgggtttttcccatgctgttctcataatagtgaataagtctcacaagatctgatggttttataaagatcagttccccttcacatgctctcttgcctgccaccatgtaagatgggcttttgctcctcctttgcctgtgccatgattgtgggtcctccccagccatgtggaactctgaggccattaaacctctttttctttataaatacccagtctcaggtatgtctttattagcagcatgagaacagacaattatagttaccatgcagaagctgacacaaactgccgtttttcttgctattagtactgaaaaactgccgaatctgcaaaagtatttaatgaaaacacaaacaactggtcaattttaaaatgtatttatgtatatacagatacagaagatacaaaatgaagtaaaataaaacttgggaaagtaaaatattcagaaaaagcctaactttaaaatagaaaaacataaaatctctaaagactaatacccctcatttaaaaacaaacacaattatcccattggctattttagctctcctgggttgaatcttatgctagggaaacagaaagccaaactgtcccactgtgacctgtgaaaccctgaaaaataattggttctctaatcaaaaagaaaagaagattaaaggagaaagaagagccctgcttcaggaagaatgagtctaaggtaatatgatgatagaagagtggactggaaaatgactaagccaacaattaaattaaaataaattgcttattttgtgtgaaatgtcgctgcaatagatcttttgataaatgtgatttccctcagtgataaaatttttccaattaaaataaactttatatactgtatttttaattatccatttaaatatgcaattataataacatatattttccatgttgtgataaaattatatatattcatatccattattaggtctgcgtaacatttgaactaggaaaaggtctctattgccagagtctctatcacatgaacagaaatattcaagtaaaaatatgttgtgaaacatcataaaacaagagtaacaatctgtgttttaaaataaaaactttaagataaggaaacttagtttatcaacaggcaatgtagacattgttatcttttaaaagttaataatgtataaatcttttctctagattagaactagtttctctttcaatcttaaatagtagtgagagtcacaaaaaatgtttttaaatgccaatggctctttaggtttatagaaagtatttccaggtttaaaaacatatatgaaataaaaacatatataatttaattatttcccagaaaaaaatgaagttagtagtatatattgtaaactgcaaaatatataatacactatgatacttgatgcacattaattaaatataatattttgaaaaggaaggggaaaaaatctttcctggtacttaagaaaacacaatataagaatttttcctaaaaatctagaaaggcatttttggctgtggtgacaaaaacatatgttaatgtgacttgatatagatctaaacttcaataaactttttttttttttttttttttttttgagatagagtctcgctcctgttgcccaggctggagagcaatggcacgatctcggctcactgcaacctccgcctcccgggttcaagcgattatcctgcctcagcctcccaaatacttgggattacaggcatccgccatcataccctgctaatttttgtatttttggtagagatggggttttaccatgttgaccaggctggtttcaaattcctgacctcaggtgctccacccacctcagcctcacaaagtgcggagattacaggtgtgagccactgcacccagtcttcaataaaccttttgtgaatagaataaatgatttaagaagttgagtcaaaatgccccaggactcctaaaatggccttcctataaaaggaatgcaagctaaaagaaagtgacataacacaaatatgttcatttaactgtgaaataagaaattttatggcatagagttgttccacagcctctgctgccaaagatatcaatgccctaatttctggacccagtggatattttaccccacatggaaaaaaggaactttgcacatgtgatcaaggttaaggattctgagatggggaagagcagaatggattacccaggtgggcccaatttaagcccgtgtgagtctttaaaagaaccttttgtaacttaggtcagagttagagaaggagatggaatcatggaagccaggcgagagagatctaacaaaatgacttgctcggctattgctggctttgatgatacaggaaggaggccacaagctgaggaatgtgggtggcctctagcgactggaaaaggcaaggaaacacattcttctccagagcatcaagaacatggtcctgttgattttagattagtgagacccatactggacttatatagaattagaagatgataaatttgcatttctaaagctgctaaatctgtagtaatgtgttatagcagcaatagaaaactaatacaaaggccatttgtgagcataatgattcttcctgtctctagctaagctaagctgaaattgaagggaaaactaggaaaaatagatgagaagctaacctagagttctcacatcactgggatattgaattaaccaattctaggaccaccaaccaccagacttcttgttttaatcattccctgcaggcaaatttcctcaatgattcacaagacaagactgatttatatacactaatacagaatgtaaaattctaaggtttttttccaatcacagatttggggggctataagtcatattctgagttgaataattttcacttcaagagttctgtcctcctcatctattacctgtgaagctagtagggaagtataaatattcactttcatttaagctaaaaactaaagacatttctttatgtgtttccttaataatttgtcaccagtttaggaaacaagtatttagttgaaccgtgtgaaggctgcgattgtcaaaatggtataatggcatatagttcactcaactaatttctattagcttgcaccacacaaatggaggagaaaaaaaggagtaatccattcctaaaaaattatcactcttccaaaccttctgctagcaatctatgaaactaaaaacattaagagttatcacgcctcctgcaaacccttgggagaatttagccatacgctttatctggcactcttatttgcctatcaaataaaggctctctatgccttaattcaacccagttccataattatattgagccatctctaccatcctcactaatctctgaaaatgtaaataactgtcaaaaataatgaattattagcaaaaacaagtaatattttatgagactgaatgagcttttcaagatcacccccaaagtcaccagttctatgctctaaaactgaatcacaacaagaaaagcagtttagaatctcagctttcaaatctcaaaattacaaatattattaggccccagtcccataaatgagtcatcaactgaaaggaaaaaagtcatggaaaaaaaaaatcagcaaataaaaacgagctttatatttattcctgattcaacaaatccctgtctcgagaaacttaatgaagcacttgacatttaagacatacataaaaatgaaactagatatacagaataatctattattattttctaaagttaatggtatgaactagtgttacagtagtctccataagtggctattaacataggtcagttaacacagtagtttcatgatttagaaagtttcacttgaaagcaaggctacagtgaacataggccatttaacttgttacattgtggaagattcagagatgatacacaaaactttacaagttgaaatgagttctgtattctcaacatttaagttcagctaacatttcctgagcaactacaatgagctgggcactgcaaaagatgctttacaatatgcattatataatcctcacaataacctcatgatatgggtattatgtcccccattttatagaggaaagaaactacgctgtaaaagccagggtcacacacttgtagggtggactccacaacatccctcacttcgcgtgtatattacacagcatggtgttagtatttacagctcaaatacttacagaagtgaatagaggtacgaaatgatgaaagatggttttaataaaaaatggcaagtttttaaagcctttaatatacattgtggaatgagggtgaactgctgtggggcagtggtaaggtggcagaagatgagaggaaaattattttaaatcaatgcagagcactttaaataaaacataataggatttcttttaatcagagaagcagcatggcatagcacaaagagcaatggctttagactcggatctgtattccattcagaggggctgcttcttttagctgaaattcaccgaagaatgtaactttcttatatataaatgtatacaatatctgccttgattctttcacataaatgtttctgggagcaaataaagtaacataagcaaacatttgactagtaaaaaatacatcaataatatgttgttttattattatctaattaatgagtttcatattttgtccagatttgacctaagtatacttttattaataaatgcatcagagtagtctgctaaagtgagattcaaaaatggacagtctgatgttgaaactgccttaaaacattattctaagttggatgaaatatttcattacatgtattggttctttgaattaaaaaaaagaaaaaaaggcaatataaatttaaataggcagcagttaagctgaggctcaggcccaggtctttgatgttacttcactctcaccactgcacaaattagagagtctaaattaattcttaaccttttttgccaaagaccccattgacagtcaaagaagtggaccctttctcaaaatagtatttttaaatgcataaacaaaaatacataggatttcaaaggaagtaaattatacttgaatgcagctatcaaaatgcattaaacagcagtttatgaaatagtaatacacatgtgaggaagcaatgtagatgtgctgctcagatctccatttaggaagaactttccattcagccgcaaggagtgcatttagctgacaggcttcaagttgttagcacctttagaatcctccttagcttttgagtccaggccacactcctcctgggcagcccccagccaatggctgagcctggcacaagtagtaaggactgccattaggacccaacgagggactcccctcacaggcatcatttgttccagagctccttcctggctagactggctgagaatttatcaggtttacaccatggtctaaggtttttcccgcccggtcttgcatcctgacccttaaaaaaaaacacatttacactccagcatctctgtgtctgcttccaggtggaagcaatcaacaaaatctgcttctttattaatgaattaaataacaagatctagttgcaagtctaataactaccttaattttgaaatactgatcattttaaatgatatttcaacttaactaaaataattctaatgtattttgaaagtatatgtgaattgtactcatggaaacttaataggtactgctatgtttgttacctataattgaagaaaaagctaaatttcaattagaggttaaagtatgtgggttttttttcctattcaagttcagaccccagaattctatttgcagaccccaagttaagaatcctgggataaagtgtctgattttgaaacatccattcttttaagatacagagatgcacttagacaagtgaaagctgtggttaacaaaaggtctctaacctggcttacctactcagatgccaacgcacatgtgaaagcttctattaaatgcacagaatacattataagatcatatgcccaaatgatttaaccttgagggacaagaacagcttatctaaacacatgaatgcataatcacctaaaaatctaaactgtgaaattcaagattctaaaatatataataaagttatttttatacagatttttctaagaatatactatactgtttaacatcaaaatgctacatagaatttactacttactatattataccatttatttgctatactatttatttaataccaaattgctatatagcatttaatctagcaagaagtcctctgtatctacttctgactctcctatcttgaccctattctcttcctgtgttccaaggatggtatcaggttaccattctaactctaggtgattccatctcttctagccaggcaaacagtgtatgtaatgggggggaggggaagggggagaacaggtaaatgaatagctagatttacaaatttttcttcttaaatagagacagggtctcactctatcacccaatctctacttttgtagagacaggtctcaatacattgcccaggctggtcatgaactcctggcctcaagcaatcctcctgtcttggcctcccaaagcactgagattagaggcatgagccattgtgcccagcctcaaaatattattaatgccctaagattacaatagtgcattcagaaggataagcctcatttaaatttccaggtgaataataacaagcactaatttgagccagagtcttgaatgacagaacatgatgcagacaaggcaaagaactgcctaaaatagggaagtgaactttaagcaatcggagggcaactggaattgccctggtgaaatggagagtaaggcagaagacagagaaaatggaagataaattctgagacaaaaggtgtgagataacaacaatgaaatgtaacaactttataattttgttaagggatgatagctacggacacaccactaagaacttactaccaagattaaaatatcaaggtcaacttgtaatatggaaaagcaacagtatcctccaatctaccattcgtcaagtgactccagtcaaatccattaccctagtatctttcctttctccagtagaagtaggaaaggagaaaaaagaaggaaaaagctatgtgtatgtacatacacacaccaatacacatacaccctagtttcctctctttctgtttgtaacatctgtacagtatgcaagaaacatgtctatttatagggattcaaaacagacatgttttttgtatactgtacagatgttacaatgcataaatttctaccacactataccaaagatatgctgtaactaagcatttaaccaaagcattaggtggacttgcaagtcttccttggctccaagctaaataaatccactttctttagcctctgtctttagttcccatttcgctaaagctttcaaaataaatttccatttcttccgcaccccaacagagaatatactataactggtaacaataagatcctttaatgggaagataagatattcttgacccatttcataatttctttaagtctttactacttttgagattcagccacagacaagaaccaaatgatatgtccctagagaaatatttcattctctactgactttctccccaatctttccaaatcagtatttgtgaaatattctgttcttttcaggaaactttactatctataaaacatgttgcatttattttggcatcatctctttattagcatgcattacaaaaaaacatatttctatgtgttcaccttaatgtagccttgtgaggtagtttaaaaaattttatacacatttgtttgtatagaggaataaattatgtttcaaacacaatgcaacatcttgaacaccgccaagttgctgggataatccacgtttatcacctacttcctcaattctttgtccactgaactatgatgtcagaaatctaagcttgatttgtttttaagtggataatccattaactgtttccatatgccataactattcagttgagaaataatttataaaccaatttatgggccctatctggcaaaaatgacacacctgttataaaatatgattacttcagaaagctaacaattgtggaaccacattttcataataaattagtctaagtgaattagactattcatatactttcagaaagccctttaatccctattaacagtttgtgaataatgaaagtagttaatattaattttacttgacaaatccaacaccaataacctgttagtatactctaatccattttccaacagcctgtaaaaattaaccaacagatgcttccaatctggtaaaaaaaaaaaaaaaaatacataggtcattagcattattttgatgataccaaatgttcaatatatgaatattatgattaaatttcagagagatagataaacaatctttttttataaccttgttaagtcttaacagaagctgaatttagtaaaatgtcagtcttttctaaaatcaaaatcagcatttgttattccactccttgttattatgcttcaactaagtacttgactgagtttcatcaggaatgtaaaagcaacatgagtatgggaagcacacctgccttattcatgctggtatccccaatgtcaagcatgaggcacaacatgcaatatgcacccaataaatagttattgagtggaacagtggtagccaataagaaaaagtggaaggtatgaaagaggaggtatgagaaaaagaaaaaacataatctggaaaagtgcttatatacatttccagaataatttaaaatacagaaagctaagatgtctcccaaaaacttacaacagagagaatcaagaaaactgaagtgagctacttaacagcaaaataaagtgtaaaagaaaatgatgtaagtgaatcaggaaaaaattactgatttttcacaggaaaaggattagagaggattcctattcctctacagatatggcacaaggtactttcccacagaagcgttgttgtaaatggtcacaaagattagtttaaaaagcagaataggtaagatctaattggaaaaaaaaaagtaggaatgtaataaaaggcaacaggaattaagaggaaagagccaagcccttaccaagaatatcttggtaatatgtaaatgtaggtagggttggatagtatcacaagaagccagaattgttttgccatcaggagaccaggagaaaagatctcagctgagatacactaaagattaaacaagataatatgaagagaacccagctgaggcactgatatatcacgtatgcacaatatctgatatagatattagctccttttccaactctaagtgtattagacctgtaaatcccagtagtctaaacattagaagtcctgaaaacctaaagtagtgtctaccataagaaaaaagccccacttacttgacaacaaataaagtctacatgacagaaaacttcaaggatctctttaaatgattggattcagttcctttgttcttactacccaatttgaatgcttgggaagcacaaaggattggcatctatcatttaaatgcctgggatggaatgtccatctttgtaatcaaagaaatagcctcggttctcagtccaaacagttactactgcaatgaaaaacagagatacaccatttctctaaaaaacccactattcttcagtaattaccatccttccctacctagttgtgatgaaaatcagccagcagccaatgcctctacctcctgcactggcttgcgaaagggtggaaagacaaatggattttcaccttggagtgaacaatacataagtgaccaggtttacttttgtttgggggtttgcctgtttttgtttttttgtttttttgtgtttttttgagacatagtcttactctgttgcccagactggagtgcagtggcgtgatcctggctcgctgcaacctctgcctcccaggttcaagcgattctcatgcctcagcctccggagtagctgggactacaggtgtgcaccaccatgcctggctatttttttttttaattttttttagtagaaatgagggtctcatcatgttggccaggctggtctcaaactcctggcctcaagtgatcaacccacctcgacctcccaaaatgctgagattacaggcgggagccattgcacccggccatagttttgaattctgcagcaattacaaaattgattcaaacaaagtatgttggactcagggagatacgtgaatgtaacatttggacccaatgcctcagcagccaggccatgaataaaagaccacaagtagacctgtctacttgaccagtcctgtctaagctctctggacatctttctctttccttcctttctgatctttcctattaaatgtctatataaaatcctgtttctctgaacgtagcaatgactggcctttcctataaaatactctgaagtgttttacatgtaaatacacattttaattgtcatatattctccttgattgccagatgaccagtaatgccaaaaagcactcttaggactcctcaaataatgctttctaggaattattctttaaaatgaagtcccaaaaaaatagtcacctttacagctcatctctgcttaccactgagaaatgttagcagggctcggagtcacaaccctgggcttccccactctttgtgttccccctggaaatgtcatctactgtcacagaaaaaaaagaaagcagcatttgagttgaattgagacagaaggtatcatagtcctctgccagcctctaagtcaagtaaagagattccaggccaaaggaccagcagtacaaaggcagagagagatggaaatatggagtatgcaaaaaatgatcaccttttcaccttaatctttctaactagtattagatagagcaaatacatcatttttttattcaaccttgaatctcaaggctaaagttagatgacttaagaattttttaaaggtccaattatttcatttagggctaacattgcagctaaattaaagacatgctaacaagtttcccttttgagcctcattaattaagaaagtaatcagagtaaggagaaaaagagagtagctgtatggcagaattacttaaatagtttttaggtaccaccatttgtacctactaggaaagcaaaaggaaaactaatcaactccagattatgaaatctgaaattctgaagtgttttacatgtaaacacaaattttaactgccatgtattttccttgattgccagaagagtacactaatcttatttgaagaaaattttgatcctccataatcaaaaggtaaaattaaaatcttattcacaaatttactagggtgagcttgctgagaaaattctccctgtgttcaaagaccaaaaatataccatttttaatactttagtcaggataaatggtactcaaaaatatctgttaactgtttttatcaaattctagaaaactaccttaatttacaattaccttttggagagagtttctaatttacattaataatttcttaatttacaattaccttttagaaagagattctaatctttcagaaactcattcaaaggaatactaatacatttttaaaatatctgccagcattctttggctgctgtgctcaagttaaacagatacataaagcatctagcatggtgcctggctaacagtcaacatttaggaagtcaactcaaccctctacacaaaggtctctgacctgtatccatccagtacaatctctccctgccacctcttcctttgttctatgagcccagggatataggtggcataagtctatagtgaaaaatttctttttgaaaattaaaaggtaatgattgatctaagtgttttgcactacagacctaaaatgtaagttttatataatacttaaaaattctgtgtggatatcagccttgaaatgtaagtagcaggcccacgaaattggatgaaataagttcaattttcacttatgtaatacctaaacaattttttaaaaatcacactgcacaggtaaaacctatcacaaaacattttggaaaatgaatgccattgcttttaatgaaaagatcatataacctactcagatacttctctttcaagctaactttgaagacattataaatctgatatttttatcccatgtgactcatagcaattaattaaattatgtgatagtcactgtaattttttttggattatactttaagttctgggatacatgtgcagaacatgcaggtttgttacataggtatacacatgccatggtggtttgctgcacccatcaacccgtcatctacgttgggtatttctcctaatgctatatgctatccctctcctagctcccctagtcactgtaatattaaagggtagtaaaattctaactacaagaaagcacacattttgtttttctatttttcaaactgaaggaccttctcatgccaaaactgtcacagaaaatatcctcttttacaaaagtctaatttatcccaatggaatatcttcaaaaataatatcatatagaaaatttaataatcaaaattttatattaaccttttgcatttttaaaacagaatttactttttaagcactttatttcattataccatttatttgcccattaggaatgtaaaaataacatgtacaggattcataaaataatgttttctgaaaattgatacataaaaagtatatgttaaaattctaaaatcaaattaataaataatcaagatgttaaacttacctttttgttggcaacaaaatgtattctcaagtttacaaagcaaatccacgttttcatacttattttcatttacttttatccagaaacagttttcagtcatttcatgaggtctgatctacaatcagagagaagactgattcatcaataggtgagtgtttcacctgtcccaagtcaagcactatgcatacactgagtatcatagctgtcagcagatatttataaagtcgtatctgtaagatttttccctgaagtgtgttcaataagatacaagttctgcaggatgttaaggtcttattaggaagaaaaggcttccatgatccaatagttgaggatttgaaatacgatttaattagcttcttctcaattgcatttctcatagtctctaataatcttcacctgcactatacattttggtgggcaggacacattatacagcattttccatgtttctgttaccatgaaaccatttttctgcaggattctgaattcttaagatctgactagatattagcttctgacaactagttaacactttcccaacatctatcaatagagaaaatttcctaagaacaccatcatttttttttgagaaacacttcataaacataggattcactgcaataatgtttaattatcaatttaattacaaatcggattccactggaacaacatcaactctcactgtatttataaagcagaaagtcttagtcaatatgaaagggatttgtcccaatactttaaaaaaaaagctattttattgtcactttgattagtgacattagaaattatgtatatataaattaaattatgtaggcataaattaaatctcattagaaattatgtatatataaatccaaaattagatttagatctaagtaaaagtattttcctctattaatttcttttacctttaaccaattcaatcttctcatgctgatttcaggtttaaattctttctttggtttcaacccaaatggcaggattggtagaggaggagaattttgtcctccaaggaatcccaggggaggtggtggaggcacaggaccactgaatggcatccgcattcctggaagtggaggaggtggtgggggaggaggtggaggcggcacccctccaccagaaggcagtggaggcggaggaggaagtgctgagtggccagttccaccttctttagagggaggcaaaggaatattacaatcagctggcaaggcaccaaactggagaaaaaaacaataagagacataactaagaacatatctacaaaacatgtaaatatgcactttactcaaaaataaggcattcatttaaaccaaaaataattacatatcagtaatttcataaggtttaaccaaaaatcaaaattccaacaatttttcttctaatttaagaatataattatagctttttttccctcataaaaacataattgccagaagtataattccctgttttgaggtagttatgaccatctaggtagaaatgtccaggagggaaatgggtatgtggatctagaagatttgaaaatcagtagtctctggagaacagttgaagccagggaagcagagaagttcactcatagtatggagagaatatgtagcatgacaaagggtctatgcacagagttctatggagtgcaagcatttaagtgataagtaagaaataagatttcaacaaaagaacttaaatggtattgccacatcatgactttgctcaaatcttctcaatggtgtcctaatgcacttgagaaaacaacaacaacaacaaactaaaattcttcgtaggacctatataagtatatcatgatctagtccctgctatctggtcttgtaggggactttcttctaattctgtgtatgtgccaacctcatgctaatttcagggcccttgtacatgctggtccctctgcctggaacattctcttcacctgaccatctcctactagcctcttcagtctgagctaacaggtcccttccttgggaaagccttatctgaccactcattttacactgatagcaccttgtacttttcaatagctcttatcaaaagtgagaatttatttaaggaatcattagcatttatctctttgacagatcataagctgatgaggtaagtgactatcttgtattatttactgctctttccccagcacctaaagcagtgactggtgcatgacagctatggaagaaatgcgtaggataaatgcatgaaagacaagaagagaaaaagccaactgggcacagggtcaaaaactatgaatgaagagagcaccacctaaaagactgctttgcagaatcaaatgccacagagaagcaaggtaaaatcaggggtgaaaaaagaaccgcctgtgtccactggtcacttttgtcctcatgtttccatggcataataagaatttaacagatgcatttcgatggatacaaagaagacattctgggttaataaataacttttgtaatatgagtagcttcttgaaattacaaacttcaattctaactacctttaacatttaataaatgttacataattttgaattttcatggcacaattatgaaaaatagaccatgtataaaagctcgaaatcaatgacgtctgaaatcatgacaaagaaaacagtgttataaaagaagttgaggccacaaatcaaaagcatgccttatcaaaaccattaagtataaagaagaaccagttcagtgttactctgggttgctgtgatcaaagatgatacttccttttgaacgtatttaataattaactatcaatgtcttaaagatatggctgaatttctgctctagaatagttcatttgataaagtgtgaagactgacttaaagatatggtttgggaggccagacactgtgactatcttgctcatcactatgtctctccagcacctaaactacctggttgtgaagagactacgggagcaaaggaattaaatcacagataacagaacatattttattcatactcttcatagtcagcatagctttgaacaaaaagaaggatcttaagataaatgcccacatttcataagaaataaaccagaatccaaagaaagaatttgccagttgttcaaacatgaatatggtggccaatattaagtatctaattctaggttttcttctcatagccataaacatgggtcatcactgtatacaatttaaaacaatttaggagattccttgatttaatttcactttcaaaacatacacttattcccattttatgtaaaagcactatgcagcaataacttattcaaaaatggtggatacgttttttataaactggaattttctggagatttacaaacaaaccttcaactgaacataattaaaaagaaaagaaagttcttaaatttacgttaccccagaccaagaaaaacttgttataaatatttcagccactgtctgtaactcagtctgaagtacagacacaatcaaatgtttctttcaatatgagagacaaggaaccatatgggaaagataaaaaaaaaaattcaataaaatgtgatacttccctcttgcagcactaaagaaagaagatgaatgagaataattttcttgtagataggagattttaatttttttctaaaattgaatactaacagatagctatctcttaaggtatctccagacagcctcagcaacaaaactatccactaagcatttaaaagaaaacaaaattgccagtaagataggatatagtatacctgagactatttcaacataactgtaaattaagatgaaaggaaaatagcaaaactatacttattgctcatcatcctgtacgtaaatctacatgaagaaatttagctatgaatattctacctccttacttacatccacataaagcatgcagatgacgtatttcttgctatctaaatgttttatgtgtagagggtgcatgggagctatctgcttcataatccagatttactctcttttttgtcatgttttaaatctgtttactttggaaattgaaaaattatcagaaaatgttctcattcagctagaggttatcttttactgcaagggacccctaggctgaaggttttaaaaaataaatagcttgagcaataatttcttgtagtgggataaagatcagtgatgaataacaaatctgagagtaaaagattttcttactctttatgctgaattacttaggaaacatgtgacattaggaacaaaaccctaacaaaacataagaaagcagattaattagtaaaagcttagatatacatacatatagaaaaaaatgacaaaaaaatagcaaaacacagtacaaataatgctataaaaatatacaagcaaaattaaagtttaaacattttgatgctatgaagatataacataacctttgctccctcactgtgtttttaatacccaaattcactcagagtggaattttacctgagacttaaaagcttgtagctctgcttgaagctcattaatctttgcctcttttttctgcaattcagcctgagtttcttggtggtcggtaaactctttttcaaactgaaacaaattaaaaataataacaaaaacaggaagatgaaaatgaaaagcactattcttcttatagaaatgtgactcgaatgatctgccggtagaacacaaattcctgaattggttttatgaaaggagtgatagagttttgaaaagtcacttacagtctttctctaggcccctccaggtcccaaccaaaatcgttcattcacaagggggcagaaaaaagccatagacaagtctgtgaccttctctctgcagagcaaactggccacagttatctgcagcattggcatttttcttcaaagtctctaaatattattgtgactttgtgtaaaataatagagagcaaagcattgtacaaattccttgcatcttccacctgcaaaaacttattcttgaaacttatctgaagtatatcaacatgatttagaggatttcattttaatattttttattactaaacaactccattctattcagtttctaactttttttcttgtaacaacataatatctcctgatatctttgggaaagtaatgataaattaatttttcaaagtccctagtgaaataccttctggaaaaaaaaggaaacaataaaatttggtgaatccagtgaattttctataataatttatatatccactcatcaccagttctcatcttgcattcaaacacattcaactttgccattattatgactaaaaacctcctttttgctcacaaacacaagcatttgactttcttaagaaaaatgaaaaaaaaaatcaatcaaaaaaatgcaactatctcacaaatgtggcctccacattttaaatacactcaaaccttaattaggaaaataacaacaatgtagaactccaccgtttacaaagggattttatttttacttagtttataaagggaatcttactttgtccttaataacactaagaggcagttgctagtccctcatagctagtaaaagatgtgagattaaaaagccagattccccgccttcagagtctaagttcaaatgaaactatgccacctccctgcaattaacgtttagataatgctttacggttttacttaacagactattttttggagcagttttaggttcacggcaaaactgagcagaaaatagagattttccacatacccccaaccctacacatgcattctctctccccatactttatagcttttgaagcataaaaagaagcattcttaaatttcattacaaaaactctgtgaaataagaaatactgctttaattcccattttacagggaaggaaggtaaatttcagactactgattctctcagtctcaacctgtgttcctttattaaaataacaaaaactaataggtaaaaactgtccaaatgtccttcagttgacgtaagccacagcaacactaccattccccacaactactacggctcctacaaacccctcttaccgttaaataattaaaaagattctaagcctatatctaatcaaattactaactacaaaacaagccatgcatgagtctcagaggtccgcccaccttctcctgtcacccagtgcttccccctaaggacttgctaaatcaattgccttcacacctcccttgcatagtttacctctctgtactttcatccctcattttactccttataaccccttaccataatccctctttagcttaaaagtcaactttttcaaagggtattcttaaaccacactcacttttctgacctgttgaactctgttcatttcattatctatcacacttagctataattcattctaaaaacgctgacttaccaaattccaattccagaagtccaaattccctggactgctctcagcctcatcttaggtgatctctctagggccatgctatttcaatatcatagccactgaccacaaatgattatgtaaatgtaaacttaaattatcaaaaataaataaagtttaaaaattcagttcctcggtcacaccagccattttaaaaagtacactatgggcacatatggctgatgactaccatgcagaacaatatagattataaaacatttccaccatcccatattagacaggccagttctatagcataaatacctacaaataggcctccatattcaacctcttttcctgtatgttccattacaacacacacttctggttctcctgctactccttgagtgctcctaccaattcctgttatgggtttctacaaaatccaacccactaatgatggcattctataggactctttcctcaccctcctcctgcttgtctcatcttccacagccatgtttaaatcaccatgcatacactgatggcttacaaatccctatcaacatctcagcttctcatctgaattccagactacaaatcagtccatgaatatatttccaaccacttaatgaaaacttttcaagacagacgaaaaaacatattttcaaaaccaaacatgtttccccctacaagatttgttttttgaatgttgctattctttgtaaagggcagctcaactaacatgacttctttgttcttaaactatcagtgacttcattataatcattactatctaagaaccctgtaggatctggccctaatctacctatttcccattacgcaataaatatttaacaacacacccgagatatgccccctcagagtggtaggttctgaagacacagttaaacagaatatggtcagtgtacttttagtcagcacagtggctgatggagaagtaaaagcaaactaacaaccctaaatcaattaaaaataccagcaataaagagagagacagagagagactgaaagctggggaatgattcctggaggaatgatgtttgacctcaaagtctgaaaaacttactagcatttcagcgtgtggatgaatgacaagcaatactttgtaaggggcacaaaaagaggtatgagaacaaactgaaggggataaagccagagatgaacacagaaataaaactgctgaaaggaattttgcaataagccaaagagttaatcctcttttcctaaaaatcctggagcattattaggtatgtataataagtaaacaacataatcaaatttttactttcaaaaactcaaccagcagcagtgtgaaagatgggctgaaaaagacatactagaggcatggaaattggtttggaggctattgtagttatccaagcgagaactgaaggccttcctgaattgaggtggaggagagggtaatgacaaagaaatgaaaaaagactacagaatccaaaaatgttagtatctgaccgaatgaaggaaatgagcgagaggagtgtatctaagatgactacagggttttgttgttttacaagctagaaaaaaagtgttgttatttggggaaaataaataaggttataaaatgcagggggaaaagatatttttagggagaagaaagataaatttggtttggatatgctcagcttgagataggtataggaaattcaaaagaaatttagatatgcatccttcttggctatctcgcgttgttcttcatactgattcctcaaggctcagattagacatcacttccttggagaaggcttccctggccacccatgactaggtgagggacctttcctctaggtttacataccacatagggtttgtctaccataccaattgcacactgtaatataaaattgtcaaaataacactcaccaacctgaaagctcataaatgtgagaaacttttctattttattcatcacctttccagtgtcttacatctataattaaagtcaaataaatatttgttgaacgaagtgatgagccaacctcgtcaaatcttcctttatatgttgaatgactatgtcaacatagtcactctcccagcatcagaaatctttgagaggtcattttctctttttgacaactaagacaaagttcactgttacacagcaagaaaaaaaattacgttcttatgagagtaagaatgaaaaagcctttctacaatatcaatatgtgaattatgaaatatctatttcataaatcctagactaaaattcataaggaaaaagaattatttcgggacttaagataaaaattataaaaacaaccacagtcataatgagtacattctaagaacatttattaaattaacttgctaatactaaagtaactgtattacttatgaaaaaataagtttccacatcctcgcctataaaaagatagctgaaatataaactttgttttagcatttttgtaatatctatagtcaaatcactgtagccttggggaaaaaatgaatctccattaaaagcacaccttataaaaactgatatgatagccttctccaaaaagagttactagagcgatattacacttacaaaattacatgcaaaaaaatgttgaaagacacagttaaggttgaggctctgcttaatttcattctctagggtgaatgtattagtgcatctgtacaagaaggttgataattcaatattctctatatactttctgacatttctggtcttcatttttcaaatttatgcaccaaaataaagaatgtgtctagcaaccatgatagcttcctgcctaaagcaaagtatttacatgtgtccttataaaactatcagaacaaagtttttgctgatatatacaaaatgatatggcaatagaaatattttatggagcaaatagtattttctgaatctaactaacacatataatttctgactaaaaggagacaagtaaccttgaacaaggtctttcttctatttatatatttaaaacctacaatttgtttaaaaatctgttgagaaactttaactccattcatgtttgactccattcatatatactatatacctaaaaatgataacaaaatcaaatttatactatctgggatgtatccaaatcaagtacttgaaagtctactactactttcctatgaagagttaaagtgcttatccagcttagaatacaatgttggctgggggaagggtcaccccacaacatgaacatctatccactgtaacactatgagactaaatttaaatgatccattaatttgtttcccccactaaactaagtcacttcagagcaacaacaatattatattcacaactgtaatcctaacctgcagccgaaggcgtgggaaataacaacctctcatttagcgtttggtaaagtcagaaccttaaggccccttaggacatttataatgttttacctaagttactcttaacttacaaaacagtgcctataatttgtaagttatgttttatcttcaaagctatagaaatgtgcaactgcctcaagatacatttagtatctgctacatcaaaaacctatactccttggcatgatgcctaacacacaggaaatattcacttcgtaaatgtttgctgtgggttcatcatggtgacaacagtagtaagaattatcgtcactccttcaatgtgaaaaaccacctgaataattcaaatcagattgactatttaaaatgcaaagaattggaataacaaattaaaagtctaataggtacttgctaagccagagataaaaggacaaaacaataccttaaatttatgcctactgttccattattggaacgctgagcatgtggaagttatttatatcctactgcttaaggtcactgccaatgtctgatttttcaaaactcaaaaaaattgcaatctcaggcataaatgggttaaagaaaagtaaggaattggctggatggttagaaatactactgagttgaaacaaaactggttttgtttgtgtaatatccaacagctatgacctatgaaaatggcaattttataaagttcaacttaatataatgaagcaactttaatcaaaactaaaagcaagttaacttttctcttaaaatttttatatatgatttcattcttaagggcttaatatcatttcttgagaattaccacaaccttaaaattttgattacatacattttgctccatcatccactcattcaaaaaggatctttttagttcttacaaagggccaggaattgttcctggtgcagggatagtgaataaaacaaacaaaatgcctcaaagtttactgttagggtgaaatagataagtcattcacatataaatacataaactatgtagcatgtgagatgatgataaatacattcaaagaaaaataaggaaagaagaatagggaaggtcaaggttgggagtggggagttaagactttttagatacagtagtcctccttggtggagggcatctatgcacacacctgaagcagataaagaagaaagaacgaataacaagcaaattccctgaggcagaagcatgcctgcagtggttccccacagaatactataaagttagtgaaaactacttactttcttgtaaagttctgatgctttctcttcaaactcttctagttttgcttgatctatgcaaatgtctaaaattgcaatgacaggaaatttttaatgtgaaacttcttaaactcattatgacttcaaaagtttagaaagaaaaaagatcatagaaaataattaaatactgatactaccagtaataaacaaaatggaaaaaatattataatgttggaatgaaaaaggcttttctaagcatgataccagaaaacagaaaacacaggaaaagccaaactcaataacaattttaaacttctagcaggcaaaaggagatgttcaattgtaataacactcaaatgtttctatcaccaactcgtacatattttaaagaaaaaagatgatgtctataaacaagcttaaaaaaaacagccaacagtaataaacagaaaattagaaaaattgatactaaaaaatcaccaaaacagatgaataaatgtttattattccctaacaatatgaaaattagcaatatgaatgtgaagattaaatgactgataatgccaagtgttggagttgacatgaggaaaccaatagtgaaagctaagaactttgctgatgaaaaactaggcaatatatactaaaattgtaaatatggattttcttttaacctagcaattccatttctgagacttggccattaggcctgaaaactcattaaaatattttttgatgttagacaaaaaaaaaaaaaactgaaaataacttaaatgcccatcaataatgaactgcttaaataagttatgatatatatacatgatagaatacaatgtagaagtaattcatatggatttcccatatgttatcccttcttttttattaaatgaaagcgatacatgaacaaagtttataaaaatatattacagaagaatttataataaaaaataagtcaacaaagttactgtatccaaatcttaatcacacttcctaaatgcaacctcttattaccatttctatactagattattttggtggttagtttcttaactgtaaataaaatgtacataagtattatttcttgatttatctatttaagacattatagataactttctattataaaagattaagacagtatttgttctctaatcctaatttttgatattttatttactaaactggattgctccagagcatgaaatatttaattttgattcccattacattaagaataacttaaaattcttgccacagtatgtcaaattatctgtgcctcatgctttccaataccttttctcccctattgcccacctttggttcttctctcacctattcatagaaatacaatgacattctcttctgtatttaaatcttttgtatttacttatgagattattctaaatatttaaaaatcagtaaatacaattaatttattaaaactacataagcacgcatcacttatacaaccaaatggtgttcaaatattttatttccttctcaagagctcagtgaaaaaaacctctcagctgccattcctaaatgacccagtggaatacattttttcagatactattcaaaatcattccacattttagtttgctgcatatttacagcaccattttcttaatttctgcttcctcttcccactccccccaccccaggaacttctaattgcttatctcttatagagagaaacaagcattttcattaatattatctagttcttcactaattatatttcattcttctcccaggactcagataatatacgaaaagaaacataaccctgcacagatacatagctgaaaatgagaggtgtattttaatagccttttcaaatcattgtgggtaatcttctttgatgttatatcgaaatctgacaaatggtgacttcttaaacagtagttacaatgtggaatcacatatcatatcaattaacttgtactctgttaccctaaaatctcttgataaatgttgcacttttaatagatcttttgcctatgcagaatttgtaatatcaggcactggtcatatggaaagaatggtgtgctgagtcatgcaaatgttccgaacgttaacaggtctttatacaatatcacaatgaataatcagataggttaataacaccagtgacatcaggaaataattttagtattgagaacctgtcagcctaaaagcagcagatacaagttttccaaaattcaaatttccacttaaaaactcaaattttctcattggcagcctatttatcggccattttctttgaagttataggctcactttatttcatttttaagaaagcaagtgcctgacgaaaactttaataaaaactcaaatgttacaacactaaataataatgctttatctttaaaaaaaaaaaaaaaaaaaactctcaagttatagaagccatcgtctgtatgagtcattccaagtttaaaaaaaaaaaaaaaaaggcttcgggggggacaggcaattctgcttgcaactcaattacacaaatattttcttattgaactcttttaatagatctttgcctatggagaatttgtaacatcaggcactggtcatatgcagcagaagtactgtatgtataaatcccatttgttaacacagaatattaaaacagtgtgtatacaagggtcaggctttaataaagttaacatttttaggaccttatcaaaggcattcttaagtaaaaaatggcagtttttgttgttttattgacagtaaagatgataatgactactcccacagtttagtgccactgccttgattcataacaaagtgccaggagttttactcaccattgttctgcaccaccagtgcaaaataccaacccaataaaaaaggcgaataatgtttttgtgctattatgaaaacagttttgacaattagggccctcaggagtccagagacacaacccgagaaccaatgccctagagctcattcatagaataagagacaataagatatttctatttaaataataaatactcacctacaaactgggttaaatctaaatctagtctttttcgatatgtgaagtctggatccattccatctctatgcaatacaatctgggatacacactcatcaattaatttgaagtattgttgcctaaaaccaaagaaaagagtaaatgtacaattgataattagtgtaactttacatcaaaacaaaactttttggctaagattgatttcaagttcaacaatttattagtaatataatttcaatagttgacacaacagattttacctgggagtgagagtaaatacaattgtcatcactttgcttttaatgaattcaaaacatcatttttatagtcttttaggaaatacagtatcccttaattttcttataaaagtcaaaaccttgaattaagtaaattagctgaaagtgaagtgataagtgcttaaaatttgtgctcagaggtcatcaactttccactgtaccacactgaaatagctatcattaattcacttcattaatacaaccaaaataaacaaaaattttctctaaaaagttttatgggagtatgtggtatactgttttccaagtgtttgtgaaatcaaatttaaaactggtactgtaagttatatataatatcaaattcatatttcttactcaaagggaaatagaaaaattcagtataataatatttgtccaaaaatcgaagtttaactaaaacctccaagtagatttcatgttgtcattacagttaagtctagtccatctacactggtcataggtgaaacatcccttaagattttgaaaggatcaacaaaattgatagatcgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggctcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtattggaagttctggccagggcaatcaggcaggagaaggaaataaagggtattcaattaggaaaagaggaagtcaaattgtccctgtgtgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaaaagaataaaatacctaggaatccaacttacaagggatgtgaaggacctcttcaaggagaactacaaaccactgctcaaggaaataaaagaggatacaaacaactggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaatggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgttggagaggatgtggagaaataggaacacttttacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacgtgtatgtttattgcggcattattcacgatagcaaagacttggaaccaacccaaatgtccaacaatgatagactggattaagaaaatgtggcacatatacaccatggaatactatgcagccataaaaaatgatgagttcaagtcctttgtagggacatggatgaaattggaaatcatcattctcagtaaactatcgcaagaacgaaaaaccaaacaccgcatattctcactcataggtgggaactgaacaatgagatcacatggacacatgaaggggaatatcacactctggggactgtggtggggtggggggagtggggagggatagcatttggagatatacctaaggctagatgacgagttagtgggtgcagcgcaccagcatggcacatgtatacatatgtaactaacctgcacaatgtgcacatgtaccctaaaacttaaagtataataaaaaaaaaaaaaagaaaaaaaaaaaagaccaaaccaaaaaaaaaaaaagttatttgagattagttgagcatgagtaggtatttattgctttctttttggccagaaacttgttagtgaaataaggctaatggtagaaatatttcctcttgtaaagcataatcatctcttcttgagaagactggttttaaaatatcctagtgcttttagatattgtacctttttggttatgccaaatattagttcactttggaaagccggtaatatgaaaaatgatgtcactcatcattagtacagaggattaaagagaaaactggaacaagaaagatgtctcagaaagggacaaaaaaaaaaagatttaataaatgtaaataaaacagataaaagattttataagcaaaaccaaactaaagtgataaacaggttgggtactattctaatgaagcacagtcctccatctcagatcatcccctagaacttctttccttaatgacttttaacatacttttcctctctaaattctaaagtgtgggtccctcaagccatttagactttcctttccataaactatgacccactgctcttgacctacttaccttacacctaataaaccatctattacagtgaagaaaatccactacagcttaacactagcaaagatgactaatgatcattaactgtcatagagtgaaaatgtttaagaaacggttcctgggtacaaatcaaaagtgttaatctatgcttgcctctatttgttcaagttctttcaagacattatctcccatccccaaatatttctgccataataaccacatttacacgtggtacatacatttaaacacatttacatctattacatttaaaaatctagatgatgtatttcttttctactcaacattattctaatgtttttaaaatgaaaatgttttaaattaacaacacaagctatttcatgtcatctttttaagaaatcataattttagtaagtttttcctcaactccacaatgtccaattatgagttcatctataatgtggctgaaatttcatgcaaaaactcactggggaggcaatactatcaaagaataatacacaacatttctggattccagaaatgtcaatctagaaaataatctccatgagcaatattggtgaggtagtaaatgtgtctgaggaatatgtgaataacttaattaagggatgaacattaagttgtcattactgacaaaatgctatttttgttggaggagtttttgaaatcttcacttttctctgtggtattgttaacaaatatcagaaattatctcccatgcgcatttaactagcgtggtattttacacatggtaagccttaattatttggtgtaaaactgaatttgatcttctccacccaattatcttgctgtatttcagccccctccctttttcccagggaaaaggggctgcctttgacatatattctccaatcgaattccatttctgtcaaactttcttttgtcccaaaagtggaaatgaaaaaagattctaatttttccatccaccaattctttcaaatgagaacatttaacattctgcaatagaacaatctactgtttgtaaaaagaaaaagaaaaattatgtgtgttcgtatcaaaagtagtttaaagagctcattaaacaaaaaatgttacaggttatctaagattgctgaaaaggtaaaatagaggtccttctgaggtagatgaaaccaaaaaatgaaggtaaaaaccaaaaaaacaacactcatagacgtgtacaccaacaagagtaagttttactgtatgtaaataaataaaattttaaaaaataaatgcatgacaaaaatatatgtaaattatcacaattctgacacaatcttggaataaaagcatattttaagaaatatttttaagaatttttttaagaaatttttttaaagaaatattaacaacaacaataataaataggagagtttggaaacatgaggaaaaaactgatggagttgtcttgagtctagcagtcacaggaagaacactgcctttgtggcaaccatatctggaatcaagatacccggggtttaaagagccaaagaaggaattaacataggtgaacatcaaatgtaaaagttcatactcaaaagatggccaaatatctaaatttctatgccttaatgtcattttggtaatgccacaatttaatctttctccaagactcttgatttaactcaaatgatagtatcacctgaacataacccaaaacagttgtgttttttaatctgttttgaagctagatacaaccacatgctctcttggggcacagatgaagggatcaaagtcataagtatgataaaacccctgcaggactacaggcatgttcaaaccattgaaaacaaacaacagtcttaaattcttgggtactcaaacagcatcaaacttccagaagacgacaggactgaccacacacagatcaaaaaatgtatggagtttactttagagtaaatagaagtttcaatgtcatttttaagtaaatttggagtagaaatatagtatcataaacagcatggtacaaatgatattttaaaaatctaaattagcaattcttaatctagcatttataatataaatatttaaactggtttatttttaataaaatatcagaaaggagcaaattaaaaaaatcagttactaaactcatattttagaatatcagtgggatttctggctacaaagagagtaattttgatgcatgtcctatcctcatcctgaaaaacctaaagttttaacattttgggtctcctccttgcttgttaggtacatcaaaaaatcactgagtcataccctctgatgttaccccgaggacacagcctgaatgaagcttgtctaaaaaactcttctacttgaaattaagtagaaaagaaaaaaacacccaaagtataagagaatgaaatttcagcaaacctaaattggtggcaacaaaatgattttatattcaaagagctcagcttccaccataaaacagtaatagaaatggaaagtagatatagagaacatttactaagcatacaccatatgccaagggtttggctagaacttttacccacattcccatatttcatctgcctaacaacccagtgagttaggcactaatctccatatttagtcacattataatgtagatgaggttaaaagaaagataaataatttgttaacctcagatggctaggatataatcaatctttaaaagccatttgtctggctttttgatatattagcaacattaaacgcaactgtattattaagacttgccagctacttaaacactaataaaagcaatgtttagtgcccttcatgtaacttataagaagaaacttatcaacatcattcctactgcctaagaaataactagaaaatattatctgtcacatgataaactagtaatttgttgctagtttgcatttttattcagatgaaaggttgtaaccaggaatccacaggagcttaaaaagtaatagtaatatcattttaccatcgtctacctaaatatatgcccagagaaaacaacacattctatgaatcagtgttatgacaaaaataaaaatcatttgcttgtcaaaggcaaatatgatgtgaatttcacaattaatagatttttattagtgaaagaaaacattagaatacaacttcctcttaccttataaaataatcatttcgaatcagcaaaagatgctgaagaatagaaataaaatatccctctgctctagtttctttaactgtgctccacaccatgttgtaaacatcatatgcttcagtgagttgattaaggaatatatggatttatttatactctacaccaaacaactataataatatgacagaatttgtcctgtaaggttttggaactgtaatacaggcatcttatatattcaacataaaatacagatatttaggattgagggtagtggaaaaactctggaaatggtgacttaacctgacacttcctgacttcccttctacaatcagttccaactaatctgtctcccctaagcacagatgctgttgggaacaaaggtagtagggaagctggctatgaatactgtgttgaattctaaaggttgcctgaccaacagagctggtggtcaggttaattatctaccatgaagaagccccaggtgaggataggaacctgttgggtctcatgaggagcacagacgtctgcagacccacagattaacatgcgacccatgagtatgcacccaagatgcagggaaagagcagccagtgactaaggctgccctattcctaatgctaaaaagccctaagtagaaggaaaagtgtcaaatataaaaagaaaacaaaatagattgcacacatacatataagaaaccaatctacagaatccatttgttagttgcagcatacgcttacatatatgtgtattcataaaaacacacaaattaataaaataataacattcttctgatgcatgaaggtttgatttcatgttgtttatatagaaatgagctaaatatttgtggctgagtattttggatttagcaataattttatatatgatttgactagacttcagaacaaaaggatattcaagttcagctctaatatcttcaaggcgatgggataactcaaacaaatcttcttctttatgctcatcaaagactttaagttggatatccaggccatcattcttaatgcattttaaattctagagatatgaaatagaaattatgatgaatgattttgtttttaattatgcaaaagaataaaaaacatataaacaataaaccaaccattcaacttgatttatagcattcgaacatttaaagtgttaaataacactcgaatcttatcatctatatttcaaaaatagattttttaactcaagccttttcccacagataaattattcttcaaggtaatttatctaaatttccccctactcaagtactcttttaatttaaatattaataaggagactgcagggcacttactggcaatatctctttcaatccacaacgcataaattcatttctgatgtgaagcctgaaatccaaatcatcaggagatgtaaccagggcattgatgagctgcatacaagctacctacaagagatcaaacagtgagacagactgggtttccaacattaaagaaagagtaacaaacgtaaacttcaaggttttgttccagcattattaaatatctttcctattaaaacaatttgtaagcaaaatatttcagtcagttataaactacagaagaaataaagtttcagtggcgttttttatttctcatttatttgagggttactgaggtgaaaggaagatggaaaaatattagccgttactactgctccataaaaaaatagaaaaaaaaaaaaaaaaacacttgtaaccaaaagctaagttcttgtccaataatatcactctacacacatacaacagaaattgaacatatccaatatacctattggatagataacacttacctaaaataggataataaaatagttttccattcatcaagagagactcaaagtcccaaagacttcaaggtcaacaagggtcttaactctagttaacaaggttataaataaacactgtataattaatttctagaagttaatttatcaggcaatggttctcatactttggcaaaaattcaaaattaccctatgttttaaccagaaataaataacagagctcactaaatcctttaatatatagcttaaatgataaaaatttttaaatcacaaaattttcagctcatgtttaacacttcaactttcaacttctccacttttttcatccctggctaaaatatatctttcatcctccaaaatccataaaatggaaacaaaagacagtctttctagagaagcattctttgttgttgttgataatactatttttctaaagtctacattctatccaagtctagcaagaactactggactactgatcaatatgtttaacctcatgctgttccctaaattgtcttttctccatcccttaaggcaaggtttatatgaatttaaaatgctgttttggagtaagacaccaacagaattctcaattcctgctgtttgaaatatatagtaattgttatatttgatatctaagcattaaaatctgaccagcatgcctctactgtcgaaacttaaggttgtttaaagtgggaatgggaaatatgtcagaagagagaggaagaagagaaacatacttaaaaaaaaaaaaaaaaaaaacttaacagaatctacctttccagtacatgttcattcagctgtaaccagttcatgtcaaaaagtcaagtttaaaatgttttccttccacccccttgccagtcattacccaggacccacaaatgttttcttcagcaatgccatataatttttaaagatctcaaagagcaaataatgcttctctacattcagagaaactaaatcaaactcagtcacctggcttctagaaaaacacaaattacagataactcacagaaagtagcaaaaacaaggaacacaaaaactagcagcaaatattacctaaatggaaaatacatatatgtagacaacagtagcatgaaatttagaaataagggaaaggataatccaaattatttccgggaactattcaaaaaggtgattctccatagaagaaaaaaaataggaaattaaattgaaataatgaattcaagttaaatttataaaattgcttcccaattctaatcataatttgccattagcatggcttacaatctatttaatttaaatcatgcaaacatgtctgtgaatacacataggtatgcactaaaatgcattgtttctttatggataaataattctataatcaaggtaaagaccaaggagttccttgtaggttttatacataatgagatacatacctgcggtatcacacaatttcacaataatttagcataccagcagaagggagtgtcaatcagcatttatgccatatcaatcaacgcctagagatatcgagaaacgttaaaaaactacaaaggttaacaggacattttgcctgtccaatgaagatatatcagtaaaatgataaaaatatactatatactgtaagaaatatgtttggtaaataatgggaatatggagatgctaaatgagaactaagacagctgaataaagtactaactaaaggattaataaaatggcctgatgaagaagtgaagaaggaagatctaagccgaggaattaacatgttcaaagacatggaacctttaaattacaagcaattcaaattttatgagcggtttgtcaaggtagaaaggggagtaacgggaagaagtcaagaaatgaggttgaacaaggagacaggagagagggcatagccttgtgtgtcaagtcacaaaattcagattcaaccagaaatagtgaaaatcataaggaattttatgcaacaggggcacaataacagaggcaatagattcaagttcagaagctgttgtagaagtaaatttttgagcaaggaggaaggttcaaacatttgaaatatgaagaaaaattgatagaatgaggtagaagaaaagcatttacaagaggcctcccacttttgttatttaactagatagaaagtggtaccattagcagacatacaaaatgtaagaagagcaacaggttttagagaataggataaatcctactttcaaaattctgattgagatgtatattagaatcattcattcattaaaaaaacaattactgactacctacaacttctgtcaactggagatactcatactcaaaaaatgagaaccaaaagtgagatgttcgtcataaggaagtaatctctgtgctctagttgatgttccaaaaatgtagcatatgatctctcttaatttgcatgttacagaaatcgttatgatacattacaaaaccaacctccctctgcgctaataagggtaagaaaacaaggaacttccatcttcttgagagcatctagttaactaaaggttccatcttagggcatcagaagcagtttaccccgatattggctcacatacttcattccttcaaagcctatttattgatgcctactatataccaggcactgttcttggtgctagacatacagctgtgaaaaaagatggaaatttctttgagagaaagaggagtcaagactgactccaaggttttgggcctgagcaacttaaaggatgaaattgtaatttattgaaacagaaatgaccacgggagaaaacaggcttgggaagagagaggaaatcagttttggagatgataagttggaaatgcctattagtgatctaaatcttaaaagctgcgaaggaaattgaagatagaagactccagttcaaaataaagcaattgccatagcaataatacgtaaaaaccaagacctcagatggaatcacgacagtatagaggaaaaaggaggtgtcagaactgtttagggcattttcaaccgtaggtttcaacatggagattagagaaataagttaaagaaaaagaaaagttaaaaaccataagtgaggtagaaggaaaacaaggagattgtggtgtcctggaagtatggaaagtggtctcaacagtgagagagtgatcaactgtgtcaactggtcaaataaaacaaggactaatcaattaccactgcatttggcaaaatgaaaacactggtgacttgacaagaatagtttctacaaagggatagagttactgttccaagcagaaactacttgcctccccacagatgccatatgcagccagtaaacaaacaattgctgtaaaatattctcctctttgccctaaatgcatctttatatgttagaagtaactgctcctttatctttgtttttaaaaagtctatgtaaagacacttatctctaggtgttatggattacaaattcaattctaatggtttggaaagccaatactgtaagctcactttattactcttgtgtcaattatcaaaaagggtcttctgtgagaaaaggtattttaaacgtaacttctagctggaggggtgtgtgtccatctatgattcaggatagttgaggatttccttagggcagcagtaaactaaaagtatagtacaaggactgacatcagcaaactccagacagcctaagactggaaagcgagcggccaaaaaggtaatgacaaagagtgggacaaaagtcagcaataccataaagtaggaaggtaaagacataacaggggccaataaagtagataagctgtaaatagaaatctcaaagatattcaatatgtggggcagagcgagtcaaaggccatcttaagaacagggcaaacgatcaaaggaaaatcattagaagccgaaagaggttaacaacaagatagaggaacatgccactacatctacatcactgaatcagcaaagtggctttctgcccttgaaaataaagtgagaagttttcttcatatgtgaatatatagtacctaaatttcctttggtacataatttactgcaattactatgttcaacacaaatatgagaaaagacaaatgtgtttatttgtacaaatttattgtacatgagaaatcttgttacatgcatataaggtgcagtgatcaagtcaaggtatttagggtgtctattccccaagtacaacatatttatttggtcagatacagtcactctattctgctatcaaacattaaacttatcccttctaccatatgtttgcaccctttacacacttctcttcatccttcctcctctgcccccactcactcttcccagactgttatctttccactttctacatccatgtgatcacaatttttagctccaacatataagtgagaacatgtgatatttgtctctctgtgcttagctgatttttcttaatagcctccagttccatctatgttgctgcaaatgacaggagttcgttcctttttatggctgaatagtattccacagtgaatatgtaccacattttctttatccattcatccactgataaacacttaggtttattccatatctttgctattgtgaatagtgctgtaataaacacatgagtgccagcatccctttgaaatatttatttattttcttttgggtggatactcggtaatgagactgtttttttctaacctttggttccctgacccttttttggacaacaaacttaagcacaaaattcaaggttcactaacaggtactatccctgagccccatccacgaggaccatccagtttttccaaaggccgacagagcagaagctttcaacctgattgcgctgatgagatttagaaagttgtctaatagcaaaagtaagtagttcttagaaagtttactcttgagtcaacatgttcatcctgggtataagtagatgtttttacaattaaatcgtggctctacaatgcaacaacatatcagcttcaggagctaaatccagattgaaaacaagaaccagtaaaatacttaaataaaaattctatcagaggctgcaaaagcttattatctgggcctggaagatacagtttagactgctattcatctttcctaccccatagcagaaatcatctgtctctctttgcacaattaaatttcacatttatcaagttaaaatgagtaaatgatgcttatggagaaatattttgcctctagtgtaaatagagaaattccaaagattttaaaattttatacacatgcattgaagtaactgcatataccccacattgactcagagaaataaaatgcaggactcaagaagctataatttataccagggatactaaagaacaaacttgaattcttaaaatatttatttgaaaactcccccaagacatcattaatttcttctatgtcctcccatgcctttttctaaaactgcctttattgcaattttcgtatgaaatgttagatggctttaaattcttgagtataagcttcttaagggcagaggtgtatttcactcaactttgtagttccaatacccagcatagcccagtacctagcagtcactgaataactaagtaattgatcggttaattatgaaactttttagttaccttcaagacattaattatctttctagttgtccactgtagaataaatgaagaaatgtattatatagacttattaggtagattcagaaaactgccagtaaactctagataatgataaccattagtttatacttgggtatgctccatatgataatatgagttcacattagaatattatctgttcctttaatgtctactagcatactggcttattatttactgatccattttaatatggttgatgttttaattgattggtacttatatatcaaccctattcatgcaaacctcaataaaagtagtagtcagaagagaaaggaattaaaacaaattaacatttgcatccttccgggatagctcaacaatgatcctaaaaataagccttttactaatagtctgtattcttcatttagtccttcactaaatgtgagaaaagtttatttaaaatagaaaattaattaataattatttgatggaacagaagagacacttaaaacaaaaaatagtaaatcaagatataactgtttattataagacctttacttggtcttgggcataataaaacctgggtaaactttgaagattaaagtggtaggtggaacaaaatcaaccaaagcaaatatacttggctaaatccagaaaggcatttaacctctaatttgttttaatgtgagtattcaatggcatatttgtctgattattgcccattgacaaatttcaaaatatagtgattatccctcacttaagaaaggtttttggtactatttttgatactttaatgaaactatttatataatgataaaaagttatcctttttaatttataaaaatattgctttttctactttttcagacatggaaaaatgcaatcccatcaaactttcaaagatctatcttctaattaaacttaatgaaatccacagattgaagagtttttttttaagttaaggaaaaatttaactatctttgcagcagccataacaatgcaactctcagtctttgactgcaggaaacataaatggcctacagccccagctgctaccttctgaaagctatcacagcatttgaattgaagtcacagttccctgctcccagccaaggcttgagcacagcaagtatactaaaatagacctgttcctgggacacatgggactttggctcaaggattccccaacaggcttgtcaagctctcttagaatttcagggcagcctgagacactttcaccccatctccactccttcccactctccttcacctagagtcagatctgcattgagtttgacagttctcccagcctcccccagctcctcctccagggtctctcacaggcatttcctctagtcccttacacatcaaacctcttgcttctcatagaaccaagactaacagcctcatttcacaatgcaagtttcaacaagggttatcattttcaaattgtcagactcataagtattataactgaagcttaatcaaatttcttattttttaggtatttaacagaacacttttgctttttcttcttgttctttatatatgaccagcttctgtattttcatatgttactatgagatacgggttaagaccatgtgtatgccagacactgaaatacatttggaacacagattttctctagtaatatttccagagacaccaatagcctggattatattccttgcttttgcttccttgaaaaatatattctagggtagagaaatatctaccacaggaatcctagaaagacataccaaccatcaatcacccctgtccagtactgcatcactgttatcaccatagcttaagaagcctgaagatataagggttgcacaacaatgtgaatgtgtttaatgtcactgaactatactctcaaagatggttaaaatggtaaatttcatgttatatatatcctaccacaataggaaaaaaaaaaacctaaagcaaacaatggctatgtatttcaacagtgggtaaagaaatgacaagatctgggtcatctttactagataatcataacaagtagagatccacagaaggacaacataaacccagctattggtattatatctaaagagtatactaaaatcagatatttagaaccctgaatgaaattaagtaaaaggatttaagtatatattttaagtgagcaagctcagaactaaagatgctacagattcacatcaaaccatcaaagacaaccaaacaattttttctctctgaaacaagcttcccatcttttcctttatttgctctctgacataattatttctcctctctggactcagaaactttggaaatcatgttttccctttattcagtaactaacatagggaaaatattcttgaggtatttccaagaatcaaaattaatgagggtttcattccattcaatctacatccaagataaaaccaatgtataggaacaacattagaagaaccgggctaaaggaaaagtagccaaggtgacactaggagatttgtggtcttctgtctgttgcaagacaattctccctgggtctctcatatttcatttccacttgtattgcaagtaaagacattgatggtctttgatctagatgctcttcaaggatgtgtgtatacaaaacaatcttggaaaacagcatatctctccagagcaaagagcaggctcacttcatgtctagtataataaagataatgtcttttagagcaaagtgcaggcaagttcaaagttcctctcctacagcacatcctgccatttaccaccagaaagttctgaccatgatttgattaccattacctacactttactaagaggtcaatcagaatagatccagctcctgcatctcccatgcaaaacatcttcccttctctctggatgtcaaccccattccaactcccataactgtagctcagtcattctgtggagtgggtgaatggcactgacaaaaaggaataagttggactgactgtcttcagacagtccctccaaaaattgttagacttaattatttcctgaaccaagaactgtaaaatttatcagccacctggaagccaagttgaaagctctgccaccctgtagtcccttaactaataaagttcctatttgggtagtcccaacaactacaaacaacactttccttccaggagcaccatgtacacctttcaagactatttatcttatgtgaaagacaggcattaacttgcctctctcttcaaaaacaccatgacttgaaccctacaggtatgatcataagaaatgttcaagtgtttaaagaaatgccaccagtatgtcatgcaactcttaggcaactatggagttctctccaaatggaagctatgcttagttactctggggagcttcctggagaaaaaaactgacttactatgtgtactctgcaggcagttatccctacaatgggaagtggtaaaaaatctgtgcctgatttcagctaaagtgatcagtgacaccacatcagccctgggaggcaatcaggtcagcttcaactcactgaccaggattgttatgaagaaagaattgtcctagacttctttgctgaacaaggggaagtttgcgcaatcactaacacatcatactgtatctgaattaacacctcgggccaagtggaaagatgaatcaaaaaatttaaaaagaaagccacctggtgttctaaggtagactctgatgatttactggattatgggatttgttcagctgactagatctgggacctggaaggcaggactgaggcaaatacttcagacaggactcattctgctgcccacagtctctcctgaacttaattaagtatgctatgaaacaaactgaacagatttcatcatagcctgtatcaatcagatcaattacagtcattgctgcccataatataaaagtaatattccctatgctcaaggtttctctcctaaaacacaacccactgcaactggcagtattcacattacactatgagtgtcacaatatgggctttgggactgacacaaagctgatactcagcctactgctattgctgtgagcaataaaatcctttgtttttaacctaggagttcacgtcttttgacagcaccaatagaactatgacagactaacatgtcagtttacaagtggcagatcgtctaagaccattcatgttcctgaccctcccatcagcaacttcatgggtactggatcagggagaaaccacaggaaaaggaagttacagcattctatcactgcagacctgaggacatatacacagaagaagaaccaaatatccacccaaaatgctctaggattcccatgttttggttcccttccaaaaatatatcacaattcaatcagtcgtatgaccaacagcaagggtttcaacaaactctttgaaatctagaaaatgctcttgatactccaggaaagtatgaccctgacaagagtagacagaagacacagaaaggaaaagaaaaagaggagagaaataaaaataacagaagattaaaggacggcagaaactagagattggttaaccaatacttatcccagtccttttctactaaggaaaaactggccaacatgagggacaagcacacacatgaacaatggacactacgatggagggtttggttctcctggggcaactgtggcagaaggctgtctgtccctggtgtcacaagtgctgaccacagcagagagttgggagtggcacttccattagagcattgctgtgatacagtgcagcgtatcttctgtattacttctagctacagaccacccacatgattccctgggcctaccagaaattttgtaaggtaggtacaaaatttgtgaagtaattaattgatataggctatgatgaaatctgttcaatttgtttcatagcatatttaattttgtaataacattttctgcttaaattacccagagtgattatgttgcttgcagctgagaaaccctgtctgatgtttgaaaaaaaagtaatgtatgcttattttaagtcctagatttatatttgtactttctttcctgataatatatatgtatgtgtgtatacatatatatatagatatatctatctatctatatatagatagatagatagatatagatatatatatattttttatgagatggagtcttgctctgtcagccaggctggagtgcagtggcgcgatctcggctcactgcaagcaccgcctcctgggttcacgccattctcctgcctcagcctcccgagtagctgggactataggcacccaccaacacgcaaggcaattttttttttctttgtatttttagtagagacggggtttcaccaggttagccaggatggtctcaatctcctgaccttgtgattcgtctgtctcggcctcccaaagtgctgggattacagacgtgggccaccacgcacggcccctgataatattcttcaaggcctgagaataaagttattccaagtacaaagtttaacattttcttactatataatatcaaatgggggaagtgtgcacaattctatcataatcataaacaaattatcattattaggatcagaataacaaaaaagtaacaattctccttattctcctttaaaaaaaatactttgtcataaatatactttgcagtaaaagaataatgaagaatgtgtttattttgctatctcattttctccaatttaaaagtaaacaattggttcctattttattcaccaataaacaagttttatttttaattggcgatttgctaatgtcatctagtttagcacattttaataatgcaatttattaaaatggaataaaatgggtacaaatagttttataggaaaattgatagccagccacctcaaaatttactttatttgtggaaaattcagaaagacagagaaataggtatttttagatattactacaatttttagaaagagcataacctgcaatatgcagaaaagagtatctatgttacctttttttgtttgtttggcctaagttagcactatagaaaatggtatcttttactctgaagcctgctacctgctagctatttcacacattaggcttaaaaacaatgagaaacctttattaaggagtaaaagccttcaacaaaatatttgaatagaaaaaataagaatgtaaaacaattctttccattttctattcccaattaagagcatggaaatttaacctgaacatatcagaaaaatgagaaagaaataaatttgaatgatgctaaaataatctttcacttcttaaaaattaagctctaagaactatatcaagaaatttattttagtgtttacaggatatcaaataattaacactactactaactgtaacagaaaatataattacaactaaagcaattagtttcataaaagcaaatataatcagctacttatatattggcaaaaatttttcaaaaattgaatcatcacctactatgtcccacaaaaattaaaaattaaaaagaaactgtatcattcccgtgacttccataactacggaaggaaaacattgctctaagctctcctcctccctacctctattcactcaacactaaatatggcaaataagcagtagtttaaaaagaaatcaactccacaaatgttcacagcagcatttttcataacagccaaagagtagaaacaacctgaatgtctgtcgactgacagctgataaaatgtggtacactcatgacagacgattatgtggcgattttttaaaatgcagtactccaacatgaacgaacctctaaaatattttgctattaataagtaaaaaaagccaatcacaaagatccacataatgcatgattacatttacgtgaaatgtctggaatatgcaactctataaagacagaaagtagatcaatagttgtctcaggctagagagaatcaaagattgtggagttatagctaagggatggggactttcttttgggtggcaatgaaaatcttctaaaattgactgtggtaaagattccacaaagctgttaatatacaaaaaatattgaatcacactttttttcttttttttgagacagagagtcttgctctgttgcccaggctggagtgcagtggcatgttctcaactcactgaaagctccgcctcctgggttcacaccattctcctgcctcagcttcccgagtagctgggactacaggcacccaccaccatgcccggctaatttttttgtatttttagtagagacggggtttcaccatgttagccaggatggtctcgatctcctgacctcatgatctgcccgccttggcctcccaaagtgctaggattacaggcatgagccaccacaacctgacctgaaacgcacattttaaatgggtaaattttatgatacgttaatttagtctgactagagctgttaataaaagaaattaaacctgtatcaaaactttatataaacagaattcttaatatttatttaagtcttaatatcttctatagaatagtaacctataaaatcccaaacttttaactgatagttctctttctagatatttactgactaaatataagtttatcatgactatagaaatgttatttttccacagaagagcaccttcaataaaagcagaactacctataaaagaaattacttaatttaccccctaaattttttaaatcaacgtagtttgccttcaagttcatactcatcaatttaatttgtagttaattaaaataaaggtcagatatatttacctttatgtctaacagccaaaacaaatattccaaataaccaagaattagactgcaatagtcgaaactttccaataaatgaggagatcatgtcatttaccaggacaaaacagggctttgtctttaacaagccattatttatctcttcccttacagtttaaaacctcatgtaatgtaatactgttgtaaacaaaaggatgggaccccagttttaccaatattttcataaaacttttactctcaaataattatagattcatagatagttgcaaaaaaaaatcagataaagtaatggttcaactttcctctacaaagttttctttagggctactcttcattaatcttcagatgaataaaaagcctgggaccagatgacaaagaaacttgttcaaagcaccagatgacagcagatcaacctgacaaggaaagacataaaaaatagaaaggaaaaagaaaagcaataggaaggaaaaggagagcagggaagggggagctcagagatgaggtgggagagaagagacaagaaagcaagagaaaagaaaagaggaggagactggaaatgaggctagcagtacatgaattaaaagactctagtctctcaagcaactaaatgggcaaggtcgatgtcacagatggggaacacatcccagacctcgaagccaatgtcatctaacaagcccagaatgcatgaaaaggggctctcttacagaggttcctgcaggacccatgccatagagaccctctggtcagatcttcaatcctgcctattcgaagagaaccaaatcacaacatagggttcctcactggctattcactaacactgtcatctgaaatgtcatactaaattattagtttcacagctcctatcatattctcattttttttttttcttgagtcagagtctcgctcagtcacccaggctggagtgcagtggcacgatcttggctcactgcaaccactgtctccggggttcaagtgattctcctgttttagcctcctgagtagctgggattacaggcacctgccatcatgcccggctaatttttgtattttagtagagatggggtttcaccatgttggccaggctggtcttgaactcctgacatcaggtgatctgcctgcctcagcctcccaaagtgctaggattacaggcatgagccaccgcgcccagcctattatttttaaaataccatttgtttacttttaatttttcactttatttttttatttcagatttagcttttctattcctaatataccaagaaacaataaaatggccaagcacccagaacctttaaaaaaaaactataactttttacttttattaagtgtgaaagagatttacttcatatctattaacacattggctttgaaactttgctgcacgttaggatcacctgaggatcattttaaatttcccaatgtccaggtcacaccatgccaattaagttttagaagtacggaggtgagaatcaggtattagtattttttaagatgaccacttttgaacaattataccaataaaagcctcttttcctttttttaaaaaaagaaagagaaattaaatgaatattattcagcttgaatacttaaatgtttaagtctaaatgtgtctttttagcagtatttttggaaacatctataaccttgggtttccttattattcacgtaagctcaacttttcagttattaaaacaatgaaaagccctaatcgacctaattggcaaaacatctcaaaagttaaagtaatttaagagactaacatagaataaacagttcatagaactatgataatatctcatacagggaaatctaataattctactacacgaaaagcaacctaggaaataaccattgttgtgtgccaagatgtatctataagataaattatgacacagtacaaataggaattctatattctaaaaataatgctaggccggacgcagtggctcatgcctgtaatcccagcactttgggaggccgacgcgggtagatcacgagatcaggagatcgagaccatcctggctaacacaatgaaaccccgtctctactaaaaatacaaaaaaaaattagctgggcatggtggcaggcgcctgtagtcccagctactcgggaggctgaggcagaagaatggtgtgaacccaggaggcagagctttcagtgagctgagaacgcgccactgcactccagcctgggcgacaaagcaagactccgtctcaaataaataaataaataaataatgctataaaagaatattaaaaggcatgcagagcttcataacaatgttttcatataaaccaatcataaaaccgttaaaagtaatatatgccatttaaaaacagattttatatacacacaaaacttacttgcagttgaactgaattgtgccggaggccttccacaatacaaaaaaatctgtcaatttttttttcttcaccagctgaagttaaagcttctaaaacttcttcaaggctattggaaaatttgagtcaattaaattgcaagtagcaaacacaaatgccataatacaattgctttatcctactaaagaagtcaataccctaagcagccaatatattttagaagtagattactgagtacataccatgtatcaagcacagttctaagcatgttacattttaatcatttatccctgacaataaccctgtgaagatgtttatcaagcatttatataatgcttactacacatcaggcaccatttaagccactttacaaacatcaactcattttaaagtatataacaattgtttgaggtaggtactataattaacccgtattatagattaggagactaaggcagaaaaaggttaagcaatctgtccaaggtctcatatctgtgaaatggtggagcaagaatctgaaaccagacagtttatgtggtgggcaccatataaatgctctcaaccactgcactcttatgcctcacaagtttaagtaaatgaagctgagtgatagtcgaaaatatataatagtatggtattataaatattcaaatataaaatataataattatgcaaaaactatacttcctcttcttttaagtaatagttaacagcatccagcacactggagaagctcacagttcgtggacatgggcatgcagtcctaaatgttacttacaggatcttgatacccattctgaagtcaagaaacaaggaaaagggaaggataacagaatagggaagggaaaagaaaagcaaggaagagtccaagaggaaagaggaggaagaaaagggaaaaagaggaggttaaaagacagaattaaaaaatgatgggggaaaggggaaaggaagaaagtgggaagggaagctcagaaagtatcatatgtccacataaatttcactcttagatttgtacaccaacatttatatggccttaaatactgaagctgtatgcctggctttgcacgcttgggactgctgctgggtgtggcaacacctcttctatagataaacactgtaggcacactttgcgggcagactgccaggctgaggccgagtggtgtctttgactatccaaccatcaagccgaacctgctcaatcccaccaactccagcaggacctccacaaggctgattttcaaacgaacacaggaggctccccttacaggactctgccaacccctacatatgggggatatttctgttagttcttttgcctgtttagtttttacatttttatcttttttaaaaggcattttaaataatttttaaatgcttcctgataattagaaccctaatttttaaaaatctttatctttataattatctttaatatgtatgtaatggtatttaattatactcctaacaaatgtggttaagttctttacagctctagtgtgtgctttatgctcaaggactttgtaccctcaaccagtaaactactattacataaatcactttctaatctgccttatatatagatttccaaatcgtaatatgtttgcttttacaaggggatagagaagacctacagtttgaaataattctatgtggggaaaaaaaatcacataagaaatagaaccatttgtatattttcaaagcctccatttagaattttttttaatttagggtttcagttaaaaaaacagtttaaatatgataaggaaatcagtttttcatagaagtatgttagaccataactaataaatcaattaagagaaataattactcaaaaatttccagccaataagaaactatattagctgcttaaatatacctcaacatttatttaaattctagtaaattctagcctagagtagataatgaaacattaaatgaatcaatctgtattaaattattatataattaggggaatatgttgataacacttacatgctttcttcccctacaatgcataccgcagagagaagtttaaccacatctgtcatcatattggggtgtctgggatccacggctttggccaataaggaaaggctcctctcctcactcataattctttccaagccatactataatattttgaaaataagaggtcaaatgttagaaattagttagaaaaataataccctgaaggaaatgtagttattaaaaaaaatttataggacatttttacacttactaaagctaaaaaatatagactgtgtaacactctaaaaagttcatggctgggcacggtggttcacgcctgtaatcccagaactttgggaggcagaggcgggcagattacctgaggtcgggagtttgagaccagcctgagcaacatggagaaaccccctctctactaaaaatacaaaattagccaggcatggtggtgcatgcctgtaatctcagctactcggtaggctgaggcaggagaatcacttggacccgagaggtggacattgcagtaagccaagatcacgccattgcactccagcctgggcaacaagagcaaaactccgtctcaaaaaaaaaataaaataaaaagttcataagggtattcactttatgtcaagaaccacaaaactaaaccaaataaagataactcaaggtgatcttacaacaatacagctgacaattattaagacaggttaagtagccaaattgagaaagtgggaagcagtcagaaacatgggatttgccaacagaagcatatgaaacaaacagccagatacggaaccagacactgaggccatgaaaatctttttcctgggaaggaaggttggtaagagatatattatcataagcaaacacacagatcaacactgtccaagagaaatataatgtaaaccacatgagtaatttaaaaatttcaagcaagcaaaactattttcaataaaattaatccaatataccccaaatattaccatttcaacatataaccaatataaaacatttattgatgacatttcacttctttttcttcctaaatagttgaaatccagtgtgtattttatactgtagcacatctcaattcagactagccacacttcaaatgctcagaagccacatgtagctaccatattacaaaatacaggcctagatattagcacttagttcataaataagcaaaaactgaaggatgatttgagcagataccatgtagaaactgccacaatgggcacaggtattctaatcacaatggtatttattataaggaaaacaatgcagttgtaaactcattctataaatgagacgattgggattaggataaagtttatttactactgccaggaagtcaaatccaattagaagataagttatgttaatgatgtatctatgaaagataactgtcaaaatacagaagatgaatagaaacaataaaacagtactatttatctagcatgcatctcagaggatcctactaaagcatgagaactgactaatcagagttactaccaaacactaaaaaagggccttattcccaattacaagcctatgaactaaactcaaaatcagcactacatgtaagcattgaagttgaatctataaccagcttagacccaagtactttgattgtgataaaatcctatttataactttcctatcttgtatatggccatttatgcaaagaaaccttgtactgggctgaaatactccatttactttaaaccactatctgagaaacacaggaacaatggagaaagtatgaggaaaggccaagggcccaagaatatgaattttggagagattactctgtcttgttagtaatagggaaaagtttacaacaagacagctaaacagtcaggaaatacttacttttatgatagcctgggctattacctaactggaaaaagaatgaaaaggcaggcacaggaccagaaactacaatatgccttgctaatcattccagggaattgtcaggtttataaagtaccacttagattcaattcagaaagtcagtcaatgattaccaagtacacaagagctggctctgtcctaataaatctgggaattgagtaaagcttgcctctagcatttccccttcttttcccacctacctggttgtccttagctaacacctgcccttctagaatcagaatcctgtgactcctccagccacccaaggtgactcatgctgacttcctccaagtgatactacctgccttctctgccaaaccctctggccctaacctatcatgtatgaaaggtgaaataggagcatactctgatttcacagttttaaccatcatcctgtgaccccaaaagtccatcacaggtaacgttctctgattttggtaatgcaaaaatgtgtcacactcattttaagactggaatgaggccaattactactactcagtatctataaatacagaattgctacttgtataaattactctcaattatttaaaaaacatagcaaaacaaaacaaaaactgttgactctgtgtgagaagttgtcaacttaccagtgctcggattaaagtgcatttaatgagggctgttttaggttagagaggcatgacaaattttgaaaggtctaaggatgtatctttcctgaatgtcaaggacccactccggacaatatggtaactggcctgttctaaactgaggatcaatgccaggttccgcctgcattccacatgaggcctattattagctaatagatggaatttcaggcactgaagatgatgttttaggtagaggaaagttaatgctctaaatcctcgtgtaggacgcccaacatctggacgcacacagcatgactactagtgctgagcagccacccacagtgagttaatcccagtagcagaaataatgtggttaaagttgctggcttcagaagcaaagcacccgcaccttgggtgcactcttcaaagcaacacacacagttaactgaccaaactgaagtctctgttctaattacctttcaatttgaatatactaacttttcatccttattatcttttctttcccctacgcaattaaaattctcttccatttaaaaaatactcttagtccaatttaatgttataagaaattcactttcatgtaatgttatcaaatttgcccattaattgtataattaattactagtaccaaataaggtaccacatttttttcctcttaaaacttatattttcaccattcaatgaatgctaataaagactgtataagtgaggtttaacaaattttgtacttatagatgtgatcaaataaagattaagacaaccattaaccaatcttgaagggaaaaaaaacttcaccaaaaatttcacatattgctaggtttagagttcagacactataatactaagtaacaataacttaaattaactttttattcttaataacacagataaaagcaccaaataaaatggcaatattttatagctccatgtatataaactacaagcaacaaaaatctcttaagagaaaaatagtatattaattagaaaataaagttcaatcttcctcagattcattatgaaacaaagtaagaatattatcttctatttaccaccttaatttaaccatgatattcttcttaaattcaaattatgatccaaatgtccctttggtttaaaaaaagttcctagattttttctacttttggcttttccatcaccaatgaaatttccaatttctatattctcactttaaaaagggcttcctaaaccagttctatgtacttagtgggcaaagacctctccctatcagcaatttgattctttcattcatttactcttaaaacagatatgtaaaaagctaccttatatatctaatatctgattttcaaagaaccgtgaattcagcatagaaaggagttgtgattcctacatcacatattttctttgaaaataatatctgtttagaggaggcaaggaagaaaaaatatttcattggttaaaaatagaaagcttagctccagaaaatgcttaaaaatacacagtttaacaagacaaaaataattagaaaatataaatatttgctaatacatgtagtaaaataaatataaaataaatcaataatttacgtactagtacttaagtgtgtagccctataaaagtttgtttttaaattagaataaggcaaaatattataattaaaattaatcagaaatatacagatgcttttgctataaaacaaaaataatcgtaccaccacaggtaaaatttccccccctgctgtctaacagcaacttaaacacctatcatcacttcacacatcatgaggtaaatgtgtttagatgctggagcttaaagaaacagcataggataatgctaatttctacagttaacagtataaaagcaaaaaagaaacattgctagataaacctaaaatctaacttcagtaaagagcttaagaattcctctttttttctagtttttttgttttgttttgttttgttttgttttgttttgttttgtttaaggacagggattcactttgtctcccaggctggagtgcagtgattcgatcacagttcactataacctcaaactcctgggctcaagccaccctttcatctcagcctcctgagtagctgggactgcaggcatgtgccgccatgcccagctatttgttttactttttgtagagatggcgtctcactatgttgcccaggctggtctcaaactcctagcctcaagcaatccctcctgcctcggcatcccaaagcggtaagattataggtgagagccacaagcaggtttctcccttctaatgtaacctctttaactatgcaaattcctccatattacgtttattctcaatattacttgggttaagcctcattgctctatttctgagacctgcttatatctgtttacattaatttcattgtagattttaaattcctagaatataagaaatcttcctaacttgaacctttggtaataagtattattgcagctcacatttaataatcatgatcttaaagctgactcacgccgtacttttgagagttaggagagggaggaaatgaaggaaggaagaaaagaggaagagtaggacaaaaaagcagagaaagggtggtgggtggagagaaaaaaagaaagaagatggggttggggtgggcagggttgagagggaggaaagggtggggagagataattaacctatacatgaggagttcagcaccagaagaggtttattcattatcaagtttctcctattgcaagacagttgaaactagaattcaataaaattcaatatttttccatcatgtactaaaaaacacatcagaacaatttaccatcactttactgcaactgaaaatcatatattacaaaattggtgacggacaaatactaattacgtatgtacatacctgcgtattcatcagggcttttagacactgtatgactttatgttgatttttctttacaactttttcttggctgtattgacataaaaaatagcagtgttggaattataattggacatatgaatgatgcttacttgaaaataattattagcaatacttacatttttccactaatcagtttttccaaaatgtctaataataatccaagcccttcatgtccaaagctttccacccaactgaaaaacagaaaaaagacagttacacattgtcagtaacgcagcttgtgttatcatattatatacctacaagtattttatatttgctatattcctaatcgtaactaaaacataagaataacaccatatataaaaattattcatgactcatcttagttgtgaaagaagcaaagatggatatgccaatagtgtgctaaactccgcttgcacaggcttgtaagagcagactgtgcccatctcttccatggttcatgtttagggacatcacgtgggtagcttgaaatcagccacagtgaaagtattcacaccaaagaaactggcaaaccaatcagagcctcccccacccacgcacccagagctggctctaaacatttaccagcataccactaattacagcccatttggggctatgccaaagaagacaaattgtacaagtgagtaaagatctatggaggaaagatgtagatcaacataaagaaaaagattactggcaaaaattaattaaaaaaaagagatgctttagcagaattccccaaaccactgaaatacattcctacaaatgttaagaatttcctaagtttcaaagttcagttgctttaaaaacaaacaaacaaacaaacaaactgcatcactgggttttaaatgagttatctccatgttcaccaaaccaaacctgtcccataaacccactgacccaatcacaggcctttacataactagaacattactgtcactagacaacagcttgcctggattacatgaaaactacctcgctagaaatgaataccttttctcagtggagattagtaaacctaggccaataaataataacaatgataataatctgtcaccaaaagaatgaaggaaagaaaagatatatgtgtgtatatttatttgtatgcctgtacttatatatgtgattttatatatgtgtatgtgtactgtttgaacagtaagatgttaaaaacaaaatttcggccaggcgtggtggctcctgcctgtaatcccagcactttgggaggcagaggcgggtagatcacctgaggtcaggagttcgagaccagcctgaccaacatggtgaaaccccatctctactaaaaatacgaaattagccaggggtggtggtgcatgcctataatcccagctactcggagaggctaaggcaggagaatcacttcaacccaggaggcagaggttgcagtgagccgagatcgcgccatcgtactccagcctgggcaacaagagcaaaactccatcacaaaaaaaaaaaaaaattcaaggaatgaaaaacagaacactataaagaataaaaacaagcttaagtcatatatcagaaaataccaaaatatcattttttcttaagatacaacatttccagtgaaaagagaataaaaaccaaatgcaacatatttatataaaaaatacaaatattgagtaaaatccagcttcttcatttgcatatttctgtaaatacaacttgacacctatcaatgttgaggatttctgattttacaaaaaagaaaaagaaatttgccatttagactggcaatctcttgtcagacaatattttactcatctcttgccagtgaaagccatgaaataactaatttttaaaatgcacttaaacaggaaagatactctcttgtaaaagactgaagattgctattatagttaaggtaaggaaaaaagttaaacagaggttgttttcaaaccaggctgctacttcaaaagtgaagggtttactcttcactatcagcgacacacagattatctgtaggcattttgaatcttgtttttatgtttcatgaaaacaactacagcatctcacttaactgtttgccttgttgacatcctattctgaatttattcctatttcacatgcagcagggaagtgaggagaaatctgagagttttacttgggctgacattgagatgcatggagagagactgttcataaggcactcctctttaatacttcacagagggccttcaatattttgtttgaagtaagttttcaacaatatccatattcaaaagtatagccacaaagatattctaaagccaatataaatggtttcagattattcatactgctatcacctttaatcattgtgaagaataaaatcactgttcatcaaactgcctcacaccaaaataggcaaagtaattttaaattatgttaatataacaaaaagactttgttacacttaatatgcttatattatgacccactataaaatttaagaaacacaaatccatgtaaatcagtaagttctctgatctacataattaataataaaaaatagctatttaaaatgtattacctttaacataattataactagaatagtgtgactcatagatggtctaaagtcaactatttctagacccactatataactctcttctaaactacagaatatgaactattcaaatagaatgtatgcctactcatgtattttatatataaactaattctctataaaacaaaacttattaaagttccgtgtaaagaggcattaaaccaaatcacttcatctattacaatcttttaagtcactgtgggaatttctcaacaacaataaaatgagagttgggcaatggccttctgaaaaccagattatacattatatctcataaaacatgtcaaaaacaagaaaagtgggacagggtacagggaaagaaaactgagacacctgacaaccaaagaaacaatataagaattaaaagaaagctaacaaaagtacttactaaaaagattaaaaattaaatatgcataaaacatctccctgttttcttaaaaatttgcaaactcaacatactgttgtattaacaggtgtcactcacaaagcaataatctcaagtgtttcaccctcacccctactattttcagcaatattatttttaaagataggggtatgaatatcacttcctatttccactggaaaagatgttcaagataaaaagtgatattgagtaggcaggtctgtagtcttgacagaggtttattgagatccatagctttctacaaaaatgaaaaaatttctcatcatcagtgtaagaagcaacctagaaaaaaattatcaactgatctataaatgattaatttccacgaactaaaatctgcactatttgttctatgcctgtcagcacagtaccatcaggcattatgtggtttaactataaactgcattcatggataaatatgcacgtttcttcttcatgaatagaaatgacatagagatcagtatgacatttgtatcagaaaaaaactgctttaaaacagcaaccgtagtgtgctaaatactaaatctacctcttaaaattctgtaacaggaaatattaaactcttctaattgcttcaaggaaaacttctaagtatattacccttcagcatttcctagtaggggtctcaatataggagaaaagaagagatgaagaggtaataaaacttaataaaaattaaaaaaaaaaaaaacagagggagagggagaacaggttcccagaattacaatgtttaacccgcctttaaatgttcaaaagcagcttagactttgaaattcagttactacttccagaaacacaggatgaaactgaaagtgtgtaaagtggtttctgacatgttgttggctttaatacagaagtaaatacagtcagtcacctcattgagcaatagaggcaacaatcaggtctcagatttacctcctggccaaaaggaacaaagcgctctcaagtatttttcccaaagactgatctcctactcttcctttgttttgtttaaagttattacctttcttcccagatgtgctcgtagaaagggaaagacaaatgcatcatgaattataatggaattaatcttggaattattacccttatgatctggaataaacataccagatcataagagcaatcttacctgatgcatactccttgagtatagggaccgtttcttatatatcatatttattccagcatgggatagactgagcactcaataaatcattttagaatgaaactaagtccccttctattgttacatataagaggttatagtcacttagaaataatatttaggtctgctgataaccaggcttgtggcctttatatatgcagaaataaacacaaagagatgacagatctccacaccattactgaacctgtctcaaccttcaagctagaaacttcaattgcaatttcagaactgttatttgcccatactgaatcaaagataataaaaccaaagacagggtcttactctgtcgcccaggctggagtacagtgacacaatcatgtctcactgccacctcaacctcttgggctcaagcaatcctcctgcctcagccttcctagtaactgggactacaagcatgtgtcaccacattcagctaattttaacttttgtagagatcgggtctcactacgttgcccaggccagtccaaactcctggcctcaagcaaatcctctcaccttagcttccaaaagtgctgggattacaggtgtaagccactatgcctggccaagtcagcctttattaaagggcacactgtattcttgatactgcactaggtatgagaaatacaaaactgaataaaatatgttctctgcccttgaaaagatcacagaccagtggttgaaacaaatgtcgaacaaaattatttccataatgcaataaatgctatactcatggtgctctgggaacagaaggtacaatatctacctctcttgggaacttcaaagcatctgctgtctgacctgagtctttctttctaagcaggagggcatatgcacaaagacattaaatgtaaaagaaatggcctgtgctgagcaacagagaaagctgtatcagagataaaaccaaacaggtaagaaagggcttgatcttgaaaaaccacatatgtaatgccatgggcaatgggagggcataaaaggactaagcatgtgtagtaaagagagtaatcctacccttgcccaccaaaagatctgcacatcttaaactcagaacatatgaatatattacctcatgtagcaaaggagaaattcagattgcagatggaattaaggttgctaatcagatgattttaagataggaaaattaccctagtttatccaggtggttccaatctaatcatgtaattcttaatttcccagcttggttagagagatgagatgaaagaaagagagtcaaagcataaaaagggatgggcaccctggctcacgcctgtaatcccaacactttgggaggctgaggtgggtggatcacttgaggccaggagtttgagatcagcctggccaacacggagaaaccccgtttctactaaaaatacaaaaatagccgggtgtggtggtgagtgcctgtaatcccagctacttgggaggctgaggcaggagaatcccttgaacccaggaggcagagaatgcagtgagccaagatggtgcctgggctccatcttgcccagacaacaagtgcaagatggttgcccactgcactccagcctgggcaacagagcaaggctctgtctcaaaaaaaaaaaaaaaaaagagcataaaagggactcatcttgcctttactggttttgaaaatgaaggaggccaaagaagagccaaaaaatgtaggtggactgaaaaacctgggaatggccgtcaactgaacagctagaaaagaagtaagaatcttaatcccacaaccacaagaaattgggttctgccaataacccaaatggacaagcaaattgagttgagtctcttattcataaacactagatgtctccatttatttggatcttctttaactcctttcatcgttattttgtagttttcagcataaaagtcctatgggtaattcattagaattacaattattttttgagcaattatgaatggtattgtgtttttaatttcattttctacaagtacattgctagtacatagaaatacaattttatatttttatcttgaatgctgcaaccttgctgaactcagtgataagttctaggagtttttgatagatttcttgagattctctatgtaaacaatcatgtcatctgcaaatagggacagttttatttctacctttctgacctgcatgcctttatttccttttcttgcttcagtgttctacctagaacttccctatggtgtaaaacaagcgtcctgaaagcaggcatccttgccttgttctcaatctatcttagagggaaagcatttagtctttcatcagtaaatagaatattaactataggatttttgtagatctctttaccaagttaagaaagttcccctctgtattagtttcctggggctgcaggaaactgaggagtttaaaaccacaaatatattatcttgtagttctggaagcaaggtgttcaaaatcaaagtgtcagcagggctgctgcctgggactctgggtagaatccttcactgcctgttcctagcttctgatggaagctgccaatccttccagtcatcagatgggactcttcctgtatctctgcctttttcttttaaggacacaagtcatactggatcaagactttaccctactcctttatgacctcatcttaattaattacactgcaatgactctgtttccaaaaagggccacattctgcagagtgttaagaatgtaaatacatctttctagggacacaactgaattcaccctctattcctacttttctgagagttttcattatgaacaagtgttgaattttgtcaaatgctatttctgcattgattcaaatgatcaagtgacttttcctcttttgcttgtcaatataatgcactatataaggatttttgtatctatactcatgatgaacattggtttgtaagtttgagggttttggttttgttttgttctatcttggtactgtattggtctggttttgctatcaggtaattcaagcctcattttaaaaaaaaattaattgctgtctgctctgctattttctggaacagactatggaaaattggcattaattcttctttaagtttgtggtaaaattctccagtgaaatcacctgcacctgaagatcttttggtggggagaaggaacttaattatcttaatagtcagagggccatccaaattatctatttcatattgggtgtgttgtagtttttcaaagaactgatctagttcatctaagttgttgagttgtatatttaaagttgttcaaagtattcccttattatcctgttgatgtcttggtaatatatcttgtttagttcatgaaattcgcaatttgggcactgctttcaagatgtttttatctatctttggttttcagaacttttttttttttttgagacacagtcttaccctgtctcccaaactggagggcagtggtgcaatctcagctcactgcaacctctgcctcctggattcaagcaattatcctgccttagcctcctgagtagctgggactacaggcacgcaccaccatgcctggctaatttttgtatttttagtagagacagggtttcaccattttggccaggctagtctcgaagtcctgacctcaagacacccaaccgcctcagcctcccaaagtgctgggattacaggcgtgagccaccgtgcccagcctagttctcaggaatttgactatgatatgtctgtgtgtgaatttctttgagtttatcctgtttgtgattcagtttaggtaggtttatgtcttttgccaaatttggggactattcagcctttttttttttttttttttttttgagacagagtctcgctctgtcgcccaggctggagtgcaatggcacaatctcagctcattgcaacctccgcctcccgggttcacaccattctcctgcctcagcctcccaagtagctgggactacaggcacgtgccaccacgcccagctaattttgtatttttagtagagatggggtttcaccatgttggccaggctggtctcaaactcctgacttcaggtggtccagccgcctcagcctcccaaagtgctgggattacaggcatgagccaccgtgcccaccctattcagccattatttcttcatgtacttttttatcctgtcctctttctcctctcaagtctccaatgacaagaatgttagatctttggttatagacccataattccctgagactctgtatgtattttttcccaatctattttttcctggtggtccagactatatactttctatcattctatagtccagttcactaattctctcctttcagcctcatgtttcgcttttgaggccctccagtaagctttttacttcagttattgtatttttcacttctaagatttacatttggttctttaaaagaagaaatagtttcctgtatttctttgctgagactttctattttttttcttttgtcagcacattcctatttgcctattgtaacacttttatgatgactgctttttaaaagattcttgtcagataattctaccatctctgtcatatcagtgtgtcatctattgtcttttttcattcagtttgtgattttcctgcttcttggtatgaccatattttttatactgaaggctgaaaatttgggatatcgtgttataagattctaaatcttatataaacctcttatttcagtaagcttcctatgacacagctccagtggaagaagagaaagcaccacctcattactgcaaggtggaaacagaagtccaagagagattctttgttaccacttgacatggatgggaatctaggtactccctgatggagagaaggaggactgcctcattatgctcaccatgtaacctacaatagcaccatggaagggggatgtggacgtctgttatcactgggtggttgtgaaagccctgactctattggcttctttggacataatgccagtggggagggggaagaatgcctcattaatgccatctgtgggtagaaatccaggctacccactttgctttttgatagtgtggtgggggatggggccacatatttttttctgcgatatttagcagaaatacaaagcagttattgccaacattttctgtcttgtttgctgccatttttgtggtcctttggtttcagagagaaggcttttgttgggacttctttgttctgtgcccactgtcacttctgggttactgacttcttcacctccaaatctgacaaaaaggcagaaagacaacccagcaaactcaccgccatattgtttcttaaatctcaaggttcctagcctgtcttcttatatttgtttcacatataatgtccagtatttctagttgtgcttagcaaaaaaaaaaaaaaaaaggaaatagtagatttagtctatctttcaaacacaagtctgaaacatccactgttagagtgtgagaacaggcagaagctcccaccaagaaaatgagaaaaaggcagtgacagtggtaagaggagaaccaagtaaacctgacataacaaatccaaaggaaagaagaagtttcaaaaagagaagagtcaagagtcaagtgctaaaatgaggtcaaagaaaataagggctaaaaagaactataaagaaatgaattcaacaacaatttataaataattctgtagaagtgaaatcctgattgcaaaagaattaaaacagaaaaggggtagtaagaacaaagaaaaaaacataatttgggattaaagagttgatggaagaaatttgtaggaggactgagatgaggacaatttaaaaaaaaactgtgtgccataaacactattacaaaaataaacagagaatattagaggagcaatgaagatggctaccacacttagctagggcctaggaacaaaaccaaacttaaagaaaaaactatgcctacaatcttgaagtggaatgatgctcatatatcttaagtttaaaaagcagaaatggtatataaggcattttctattattattcttaaatgtttttgttcacatataagaaatgtatgtacatatgtgtagctatacaaacattcttaatcatcctccacctagtcagctaattcaaggcttgagttctactctcttatacatccccacacactgctcccaccagaaccagttgggtttctttccaaatccattcctgacagttgtacctactattgtatttatataattaatattatataaacagataacacataattggggaaaggggtactttttctatgaaaactaagcgtaatgatttggaaagctaaaaatagattactttttaaattgctgtagaagtaaatgtgggcacaactatatattaaagggaaatcgtagtaccaaaaaaaatttttttagcagaagaatacttctgcattcagattgctctgccagagcctttatgatcctgttcttctttaaagcaccaatatcaggaagacaacgcattatgagtatgctttatgcaatcagcctttgcccactccaagaaaaggtctgggctccatatgaaatgtctacagaaaaaaatgtttatgctttagattgaaaaaaaaaatgtttggggtatatttgaatcatttatttgattattacatgctttaagcaacttttttaaccaaccaaccaacggtattagacaggaagacttcctctgtagacaaagtgtctctctctctctctcctccaagaagttagtgtctatttaagtagataatattatacatttttcttgattttgcttttgcatattttcttattgtcctataatgatcttatcttttttgtaataagaaaaatatttttaattacccaaaagaataatcttacatgaatgcctagggaaacacaaatctagatggtttaaaatcaatacacaaagcttcttaaaaggagaaaaaatacattactgctcacatgtgacaaactaacaaattttgtaccttaaacttggaaggtcagctttaatactgtataatatctagatccaatttacattcttctgtcagagtaatatatcaccaatgctgaatataattatagcttattttaagctttcattttcacctacctttaccaaggtgactaaatacttaaaatgaacagttctaggagggagtacaaagcacttagcatgccctgtggggcaagacaaacatacacctacatgccattcaatggcccatccacccaaattacactaaattacagagcaaggctgggaattcaggaactattataaataatgttcagattgtaaaatctactaaccttcaaaatacaaccactaatatgtatattttcttgaaatatacttcttaaagaaactgtatatttaaaaacaatcatttattcccacttttcatatcagataagataacacagtaataaatgtagtattctcctagtttctttttggctataacatactgaaaggcataaaatatctagagaaagcattccaaataaaatgaaaataaaaccaggttaacaggaatgataaaaaaacaaagcacaagaaacaagagttcttgacctttagatgaaaaaacagtaaaacaagtatggattttaaaacatagatactggtatgtgctctaatcaaaacttaagtccactattaaaaggaacatattataaaaaaggaaatatcttatttggaatgtgttaaatattagtacactaatatttaactaaagggcactaccagtaccagtaagtagtttcttagtatcaaattaaacatcattagttcaagaaagcactaaattattcattttaaatatagactaatttgccaacaatatatgtggaaaagacgttatggtcacatttcaggcttttcaccgcttgtccccaccctaaatacttgtcactactacccaatgctggtcagagcagtcctaattattaaaacccatgatcttcccttgattctataaatttcattgctacttttgtgtggcaatgcactcataatgctcccctccacagaactgcctttgtaacaactgaaacaatttcagctttcaaggccaattcacatttccttcttctttgaactctcgctgatttgatttctccatgtgttcaccaagttccattcacttgacctcagatacccctcaagttagttcccatttctctcctttcttttatagcaaaaggtctcaaaaaatttcatcacaagcatggtcagcacttcttgccatccattcactcaatctcatttcagtctggcttctaccaccaagactccaaaaaaatctattttctaaaaggacgccaacaaccttcctcttgccagttccaataatatcatcttgccccacctcatagcagcacgctatgcagtttgtcactcccttattttgaaacactcttcctttaggtccagaaaccagcatttggggttctcctccccactggctactcctcagtctgtgtttctgcctcctcttccctttctggatcacctatttctggacactttctgaacccggagtccttcagaacttgttctgaccgctcacctgtatctttagcttccttctccatacaacctgcccacactgggattgcatccattctcaggacttaaatatctccactccacatatgtaagctccagactcacacatctaggggtttgcttgatgtctcaaattgtgatactcttttaaacatgtcaaacttaacatgttaaaaagggatatttttggccgggcacggtgcctcacacctgtaattccagcactttgggaggccgaggtgggcggatcacaaggtcaggagatcgagaccatcctggccaacatggtgaaaccccatctctactaaaaatacaaaaattagccaggtgtggtggcatgcgcctgtagtcccagctactcaggagcctgaggcagaagaatcacttgaacccaggaggcggaggttgcagtgagctgagatcgtgccactgcactccagtctggtgacagagcaagactccgtctcaaaaaaaaaaggggggattttttttcttctccaaaattcacggaacaagtaacaacctcctccaccccaattaacagcactactatctgcctatttgctcaagtaaaaaaaaaaactgttattctcgattcctccttttcattcacatcctacatccaatccaccaacaggtcctacagtttccacctccaatttatctgcaacattcacccaccccttggcccaccactgctacaatccttatacaagccaccctcctaattcatgtgactactgccagagcctcctatctcacaccttcttgtccactctctcctcccttcaatcaattctccctaatatgatttgggtctctgtcaccacccaaatctcacctcaaattataatccccataatccccacatgtcaagggcagtaccaggtggaggtaatgggatcatgggtgtggtttcccctatgctagtctcttgaaagtgagtgagttctcacaagatctgatggctttataaggggaatttggcatttgccctgcttccactcactccatcctgccaccctgtgaagaaggtgcctgcttctcctttgccttctgccatgattgtaagtttcctgaggcctccccagtaaagcagaactgtgggtcaattaaacctctttcctttataaattacccggtctcaggcagttctttatagcagcctgagaacacactaatacacttcctgtggcagttaaagtgatccttttagaaagttaagccagaatagctcatctcctgcttgaaactcttcaacagactccacttccacagaatgaaaatccaataaccctaccacgagctttatggccatgaccttccgcatggcctggccactgcccaccttctctgacagccttttggattccaccatcctctcctctctccatccctctgccacacggtttttccacctcatgttcagtactactgcccactcttctctaaactagttccttgtcctttggtgtcaaactccaccacctcagaaagactttctataatcagctaaatcaaaaaacctctccattaattactctcagtcctcattttttcttcactgaactgattatacctttttgttttatttatttgtgttctaggtttctctctcctatatgcttctcttttactgtggtacctagcatagcccttggaatacttgttgcatatatagattacaaaatcctgtgctatattttagtggcatgttatccatgtcacatacttaggaacttaagagctttattctttcacatgttagatgtttctctctaaaaggaatcgcaacaatttaagaaaagaaatccttgcacctcatctagtattccaaacagagaatacataaaaacacttgaaatacctgctctcctgtcttgcaaatgagcagtacaggctcatgtattttactttatttcaagcattaatctccttattctgtttttactattcaaatccatttaacatgtactctgatcttctctcctgagtcccatattaaggcttcacaatgatacaataccgggtcccctcctcagaaattcatagcacagtggagagagcagccacacatatagactcaagagtacaaaggctcaaaacaagtgcacaagaaatgtttttctgatctctaaagatgtgttgtccaatagggtagcctctagacacatgtggctatttaaattctgaatttaaatcctaatcacactagcaatatttcaagtgctcaacagccacatgtggtaagtagcttctgtaatgaacaagacagacatagaccatttttgtcattgtagaaagttctatcaggcttctgttcaaatgcgctaaacttctacttagccctgcagagggactgcaggtgatatcagtggctctaacattcttttgggtgtttctttcatattattgtattaggccattcttgcattgctataaagaaatgcctgaggcttgatgatttataaagaaaagaggttaattggctcgcagttctgcaggttgtacaggaggtatggcgccagcatctcctctgcttctgggaaggccttaagaagcttctaatcatggcagaaggtgaaggggtagcaggcatgtcacatggccagagccagagtgtgtgtgttggctggagagggggtggggaggcaaacttgtaaatgatgagatcttacaagaactcactcactatcacaaagacagcaccaagccatgagggatctgacccatgatccaaacacctcccccaggccccacctccagcactagagattacaattcaccatgagatttgggtggggacaaatatccaatctgtatcagtctgccccaagcccctcccaaatatcatatccttttcaaattgcaaaatgtgatcatgccttcctaatagtcccccaaagtcttaattcattccagcattaactctaaagtccaaagtgcaaagtctcatctgagacaaggtgagtcccttttacttacaagcctgtaaaatcaaaaacaagtcatttacttccaagatacaacgggggtacagatattaggtaaacattcccattccaaatgggagaaatcagccaaaacaaaggggctacaggccctaagcaagtttgaaacccagtagggcagtcattaaatcttttttttttttttttttttttttttttgagatggggtctttcgctttgtcaccaggctggagtgcagtggcacgatcttggctcactgcaacctccgtctcccaggttcaagcaattctcctgcctcagcctcctgagtagctgggactataggcacaggccaccatgcccagctaatttttgtatttttagtagaggcggggtttcaccacgttggccaagatggtctcaatctcttgacctcatgatccaccgccttggccttccaggcgtgagtcaccgcacctggcctgcagtcattaaatgttaaagctccaaaataatcttcttgactctgtgtcccacatccaggccacattggtacaaggggtgggctcccaaggccttaggtagctctgcccctgtggctttgcagcgtgcaccacccacagctgctctcagatgccagcattgagtgtctatagcttttccaggtgtagggtgcaagctgctggtcaatctaccattcttgggtctgaagagcactgaccctcttctcacagctcaactaggtagtgccccactggggactctgtaagtggtccaaccccacatttccccttggtactaccttagcagaggttctatgtgaggattctgccagcccctacagcagtgttctacctggacacccaggctttctccatatatcctctaaaatctaggcggaggctaccaaacctcaactcttgcattctgtgcacccacaggcttaacaccacatggaagtcaccaagacttacagcttgcactctctggagctgtggcccaagctgtaccagggccactttgagctaaagctggagccggagtggcagggaagcagggagcagtgtctcaaggttgcacagagcagcagggtcccaggcctggccctcaaaactattcttccccaggaggcctctgggccagtgatgggaggggctgccaaaggtctctgaaatgtcttcaaggtttttccctcatcgtcttagacattaactcttggctcctttttagttatgcaaatttgtctagcaagtagttgctccacagccttcttgagttcctctctgaaaaaacctttttctttgccacatgggcaggctgcaaattttccaaacctttatgctcttcttcctgttcaaatataaatttctttgctccaacattggaacataggcaattacaagaaaccaggccacatcttgaatgctttggtgcttagaaatttcttccaccagataccctaaatcactctgaagttcaaccttccacaaatcccaagggcagaagcaaaatgcagccaaattctttgctaaggcataccatgcatgacctttgctctggttcccaataagttcctcatttgcatctgagacctcttcagcatggatttcactgtccatattactatcagcattttggtcacaatcatttaatgagtcgcaaggaagtttcaaactttcccttatttcccatattcttctgagctctccaaattcttccaacctctgcccatcacccagtaccaaagttccttccacattttcagatatttttacagcaaatgccccactcttttttttaccaattttctgcattaagcaattcttgcatttctataaaaaaaaatctgcatctgggtaatttctaaggaaaagaggtttaattggctcatggttctgcaggctgcacaggaagcatgacaccagcatctgcttgccttctgggtcggccttaggaagcttggtggaaggtgaagggggaacaggcacatcacatggtgagaccaggagcaagaaagagagtgtgggcagaggtgacatacacttttaaatgaccagatctcatgaaaattcactcactattgcaaagacagcaccaagctcattgggatctactcccgtgagcctaacgcctcccaccaggccccaccttcagcactggggattacaattcaacaggagatctgagcaagaataaatatccaaactatatcaattattatttatgaaatttaatatacaagaagctgaaataaactgtacctgttcctttcagacatatactgcccctctaataaaagaactattaatccatcatcaatctaattgacggagttttactcttaaaaagttttctgaatgataaaaattaaaacttcttctattgtcaatgtgatgccttcctttgtattaaggcctttcttcatgtatagatatgtaagggaataccaagataaacatcatcattttaaaaatcttttacttaaccgacttggcaatactctaagacataataacaagcccagaaaattaatctaaggaataaactatactgattctttgtatgtagagtactaataactagaggctttagtatctgcagtttaataatttctctcattgaaaatatttatctttcaacagaaaccaaagaaaccaaaatattcagttaataacttcatactgatagctgtaaagccataaacacataaggtttacattctcagaaaacaggcattaacaattaaaaagaaagaaagtttattatattctacctttatatccataagaaactgtaaagtttaatgagtttttttttccaaattgttttggtttaacactctaccttctgttgttgtcttttaaacagtaaactgatagtttcaaataattaggtttgttttgttttgttttgctttgctttaagaggcagggactcactgtgttgcccatgctagagtacagtggctattcacaagcacaatcccactactgttcagcatgggagtttaatctactctgtttctgacctgggccagttcacctctccttgggcaatttggtgatctgccgtgctcaggaggtcaccatattgatgctgaacttagtgtggacacctgattggcacagtgtaccacagcccagaattcctggactcaagagatcctcctgcctcagcctcccaagtaaccgggactacaggcatgtgccaccatgcccagctcaaataattaggttttagttacattttctccccgttatacttaagtatcagtaatatagggtacaaaatctattttttaatagagtagttgaatttaactaatctagacatacatgagctctcgtagttatatgaaactgcgttaaaaatgaagattttggattctgtgtcacattgtgactcactttacatgttaacagaattttttttaaaaagtcaatcttggccatttaaacagctatattttaaataaactgggagatatatatggcagatatatataccatatatatgtatatacgccatgtatatatgtacagcatatatagatatagatataactttaaaaaatagatttggagcactttacaattccaggccctctcaggtcaactataaattgagctgagtagctcttatttaccatctatagaatacacgtgtctgttaaaagcaattaataaattttccatgtgctctttgtttactgttaaccctgtattcaaagccaaagcttttaagatacagatacactttgaaaccaaatatttatacaacattttgctacatctataaaccaaaaaaaagctatagaatgaatgacggtatacaaaagaagcagcctcctacccctagggaacattcagtcttctagaggtctcttagagaaatggtgctaggtttggaaggactgtgaaagcatgagaaagtaatggcttgtcctttgaaaatgtaaagttagtacttatttgaaaacattaatagttactttcttccacgacattttttcattaatatttcatcaatttgacatgcttttagaaaggacagccacatgacttaaaattagaaggtattttcaacaaatatttatttaataagcaatgctacttgtcataaacattacaaactctgaatggcaattaagaaataatagaaggcatatttgaagatagatggcagtgtcaaaacaataaagaacaatattaataacctacctaatactttttgacttcttattggaaagtaatcttgaaaaaatgcctttaagaggtacaagtaggcacatctctctaatgaaaactctgtttaaaaaatgcatcccgctaatatttttaatttaccagagatgtttctacaacttctatgatgtactatattgctgattccctcattccagctacaggctgttacaccgatgactgccagggaccataactatagcacttcctgtcagacatacttcacctctccttttctattccttaatacctggtataaagcccactccctcccttagcctcatcctgctaagccagcactctctgctgaagggaaacctccttagatcactcttctattcccttgggactctcttgagattaatgtccaatcatccttgcagattttaaaaaacaatcttcaatctgtcagtgtttattttctttataatagtctcaccatctggaatataacattgagaatgtaataataatgtagttaatatatcaaagaagtggatatgcagaaccaaggccccttaggcagcactgtctaatagaattgcttacaatgacagaaatggcctatatatatatattgtccaaaatggtagccactaactacatgtggctctcaagcaattaatatgttgttgtgtttttttttcattcatttttagttaactaaatttaaatagccacaggcagctagtggctaccatattgaataacaggaaagaaaacagagctgcctgcattacttacctccgtggtatcaatatcaaagagaaaggaagaaaagagagaaagaaaaacaaaggaaaggaaaaagagaaaagaaatacacccaataaaacctttactccacctgcccctttcagaaattatcactactagtatcaaaatgaatctgaatatatcgttaattatcaaacactttttaacctaaggtgaatttttaataagtttttataacttgttaatctaaaattctaaaacatgccatgcaaatctaaaaaacatatccagaatggagtagagagagacaaataaatgcaaagtattaatgatagaataggaaataataaagtatagagcaagatggtctaacatatacaaaattagaggggaaaaggcaatacttgacaaaacaatggcaaaattttcacagaaagatacccatcatattcaaaaagccaaagaaaattccctatcagaataaaaaagaaagaaatctcacccagacacgtaaaagaaactctacaacaccttaagcatagatatctaaaaccctcaattgcatctcaattgcatgccctaggaaggctatccttccaaagcaaaggcaaatagatattttgagacgttaagtataataacaaaaaaaaaattgtgggtcaacctgattaaatatcatttttaaaaaagatattttcaaacagaattttgccatcacactctcactaaggaatcttaataatatacttaaagcaaaagtaaaataatctggggggcggggacaaaaatcaaaaagaatgatgtgtgtagaaacatatatacatatacacacagttataatatgactcaataatagtaaaatctaacttattaaaagaaaacagatacactgaaatttcactcaaaactagcatacaagtgaaaaaagattttaaagtattctttggttcaagagaagagatattgcttacttttgtacctttgaagtacatgcaagttaaatttctttttaaagtgtgttcatgttaaatttcttttctaagattagaattagattagtaaatgaggaaaaataaaataagaaattaaatatcaatccaaaagaagttaaggagaataaagaggaaggatgaatatagaaaaggaagaagcagaaagaagaaatgaggaggagcaggagcagtttggatgatgaacctggaaaaagtagcataaattaaaaattcaaaatgaaacatcagatataaattccaacatattttcacaattgatacaaaaagttaaaactaccagataaagacaaagattatcagacgggataaaaaaattattcatatgctatttataatagatattcctaaaatacaaggtatgaaaatgattagttgggaaaaatgtaaacagctgcacacatcaagatggataaatctatgaaacaatattgagaggaaatacaactctcagaagaatgcatggaagatgactggttaacatacagttcaaaaacatataaaaccaaacagtaggttaattaggaatatgtatatactaaaactataatagaaaggaatgataaacccaaaactcaggatagtggttaccacagaatagtagggggaaggggtgtttaggaatgaatgagggtataggattaaaaagggatgaaaggaagcttcaaagctataggcaatattatatgtctcagcctcattagtaggcaaggagatgcatgttatattgttatgacaaattgtcttttggaaatgtttaatatctaatttaaaaatttaaagtaagtcaaagtattagcaacttcaaatttctgatcttgaaagacttcctcagatcatgttgataaaaatgagtacactgatctcactgcttgtcacaagtttttctgtctttacacatgtgacttatggtatgaactagatcaactccgaaatcaagatgttccacctgctttgtgtttttaatcccagaaatgaagaaaaaatggattccaaaaacgacacttattaaatggaataatgacattcaaaggctgtttacttgttttcacgtaaacacatacatttctgcaaaattttccaaaatgattttctcaaaattatagttatcaacttaagaatctctttagaaatctaacaaaaagataactttatgagaaaattattcttgttaatttgaaaatgaaaattttaactatgattaatggaaaataatgcctaaaatttcaaaacacaaaaacctgataagcctagattttgagacaaaaaatcttacccttgacaggcacgtcaaattaagaaaataaagataccttctatcactaatttgctatatgcatagatgagtatgatctataaatgctgatatcaatcaaaatgatgttgctgtctacctttttatgtttctacccaaatgtattccataattcaaacataattattgactatgtcaagatccactaaaaataatatttgataatttgaagaaattggtcttttccctggtgttcagaactagctcaaaactgtcaccgagaatactagataatcaataaataacaaatagaagatgtttgtgatctctacatcaaatcttcataaagcaaggcaaataatctagtatttagcatactgattttcacataattcatagagagtaaaaggctgacatggctcacaattgctaggcagtttcagaagttgaagagtggctctaaaaatattacatatccagagccaagaggggagagctaattgggagtacagaggagtctactttttccttgatttctttctctttttttttttgagatagagtctcactctattgtccaggctggagtgcagtggcatgatctcaggtcactgcaacctctgcctcccaggttcaagggattctcgtgcttcagcttcccaagtggcagggagtacaggcatgcatcaccatgcccagataatttttgtatttttagtagagacggggtttcaccatgttggccagactggtctcaaactcctggcctcaagtgatccgctcgtctcagcctcccaaagtgccaggactacaggtatgagccaccgtactcagccttccttcattttttatttaaataaatcctgaacctacaccagcattggaaaaccatcaatcagttcaattttcttttttgttctattcagacattttaaaaactttaactctaatttacttaatgatattacaggtctaacaatgatctcaaacttaagaaaaattagaaattctttttagtcacatactgtataaaaattaaaaactgattcaaagagcaggcatatcataactaacaggaaagtccaaaaatttgatcacaggcataacttccaagttttacatgtccagctaagtcatttctctaattggaacactggacaaagaaatattcaaaagtatcttcttgagcctggcacagtggcttacacctggaatcccagcactttgggaggccaaggcacgtggatcattagaggtcaggaattcaagaccagcctggccaatatggtgaggcctgtctctactaaaaatacaaaaattagccaggtgcgcacctgtaatcccagctactcgggaggctgaggcaggagaatcgcttgaactcgggagatggaggctgcagtgatctgagattgcaccactgccctccagcctgggcaaaagagtgagactccatctcaaaaaaaaaaaaaaaaaaaaaaaaaggatcttctcaattttctctctaaataaagtggcatgatttcagaaaaaattctccaatgatattttctattcttttcaattaaaaaaaactacttcatggataacatcatggattcctaataacatattctagaattgtccatccttagagaaagaattccaccagtttctagtttttcttctttaaataaggttcaaatgaacaagacacagcataatttcccagtgtttttaggtaaaatcacaataataacccattgtaagatgcatgaattcatatataaaaaccttctattttgttttcttttgttagcacagacatctacttttgagtagatgaagaggagaataatagtagtagtaaataaagggtctactcctcattatattgaaaaactatgaatatttccagtgcccactagctgacagataaactgagaaatgagtgtgaattgtctccccagtcaacacccccaataccctttctatgtttaaactccatagaaatacgatgtgaatctgctttgtttattcaagccccacacccaacatactactggaaaacagcaggtgctcaataattttttttttcgctctcgcactcaagctggaatgcagtggcacgatgccagctcactgcaatctccacctcctaggttcaagcgattctcctgcctcagcctcctgaatagctgggattacaggcgtctgccaccatgcctggctaatttttgtaattttagtagagacggggtttcgccatgttagccaggctggtctggaatgcccgacctcaagtgatccacctgccccgacctcccaaagtgctgggattacaggcttgagcctgtaatatatatttttaaatgaacctggacaaatatatttttaaatgaacatattctacaggcaaagattaagctggacaccaaagctcttcatttatgaatatatctgtcaaataaattccccaatccattctcagtttctaacactagccaaggtaagactaaagaaggctaaaattaaaacctcattgtttcaatcaacaaatctttatggagcatttcctacatgctaaacagcgtgtctggtaacgcgaggtaaattacacatatgaagccctagtctcatgccaaccattagtctgcagtctagaggacagactggaaatggcaaaatatggaaaaataaagttgaaatatactaaagtttctttgttgactcatcatactccttagataaatctcactcagtctcacatctcagcaggtaaggttgttttcttttaaatacatgtacggtcaaagatttctgcatactatatcctagccacagaaatgtccaaaaaagtaataatcagagcaaattcttctccatatcatgaacctccaattatagtatgcaattctagccttcagaacacacacacacacgtatagatacatgactacatatacatatattcttatgcagaaataatcattcatttcttacacaataaaaacccaaaactgatctacaatccttgtagctctgaaattctctgtttctgactgtttaggtatttcataacaacttctgcttgaattttttcaagaatactcttgtttagccacctacctaattcagagttagcaaatggcctctgaatagactgaaatctctctttttaagcaccacaattaacatacatgatatatttcaggtacatcttcctgatttttgtttttttaacaagtctgtctcctaccatgcaataatctgacaagtttaaatatgtccagtttatcaaaatatatttacactgattgttcaattttgttcacaactatttcttagaggcaccaaaaattagccccattccaaaactgacttatggaaacacctatggtattgttttcagataaaatacaggatacaaacttaaatttggacgtcagataaacagtgtgtgtgtgtctagaattgaatatttctggtcattctgtacttttatttggtaaatatagcaatactaacctataggcccctacaacgacatcatttccaacaacagaaaaaattaattagtggtatttcttactgtgtcaaataagatcagcaagtaaatatacaatgacaaaattcagggtgaaactcagtcatattaaattaatagtttctcacatgacaattgtcttttagaaaacaccttaagtttctaaaaattctatgtgggcaaaaggcttttttacagtccctgagcaatgtaccactcagtaataaatgcaaaaggtactattgagactatatttcttcctgcatataaatattaggtattcagtttgtactttgagaaactgttgaggtttaccaggcaaaatgaaaaaaagtattaaactaaaagaacacattaatgacatctgccctgttggtgttcaaatagatgaattacctcacaggattgctggtcaaagacactcggagagactccaggcatgtgacaagtctctcatctgcagaccccattttcagctcatgaatgaattcctgaggtgagatctgtcggcttctcttaagacttccctataaaataagtcaaaaaatgttttgattaatactgcatggagattacccattaaaaaataacaagttaatctccctaacagcagcacataactactataattaacactatttgggcaagggtggtaaataatttccttacttctgcccaaaaatctatgaattcataatgtgtggtatccacaaaagatagtaatataacatcagaaggtgtgcaaattgaaataactgccttctcaaatgtaaaatgacatggagaacaattgtatactatagaaaatatcttaaaatacagtaatatttttaggcacacacaaaataaaattcaaaactcaatacaagaactaccctattaaaattagtattctgagcagtgtagaaaaggctattaggtattaattcattcaactatcactataagcctagttctaggcactgtagacacatggattaacaaaaagcgaagtctggaagaaatgcaagcaagaaaataataattttctttacagtctagttcctgtaacacagcaccaagagactcaaagaaagaacatctaacttggcagaacagatcagggaagcttgcaaaacagggctacatcttcctggtttttcttttgtaagtaagcattagggaggcaaagaatgagaaaggaattaacttccagaccaaaacataacacacacgtacacatgcagagaaaaacaaaaacatatgcaactgaagacagaggccagatcatggagtgatagagcactactatgcaattagctctcctggggagttttggaaggatcactccagtgtgaaatatgaattagaagagttagagttcactcattattcaacaaacattaagtacctactaaatactgggcactgttttaagtactgagaatagagcagagatgaaagaagaataagagattgaacttcctacctacatgtagctttactacatatggggagaaacaggcaatacataaaataacgaaaatgcattgcactgtaaataataaatgctgtagagaagaataaaagcaggaaagagaataagtagcttcatatgagacatgcaattttaaacaggatggtcaaagaaagcctcacagagaagacttcaaaggcctcaaacttgagtgtttaaataaaaagtctgaaggagataagacagctaaccatgcatatacaggaaaaaaaaatgctgtgatggagggaactgtaggttttacagtccactgaaagaacttggacttttactctgagatcagaagcagagagatctgttgagaaggtatctatatagcctagataggaaatgatgaggatggtgaactaacaataaagttctgaattatattatttgaattacagattcaccatccaacggcaggaaatgaattgtgtaagttcaaaagaagatcaggtgaagtggtacgaaattcggtgtttttcatgttttttgtttttattaatttactataatgttattcaaaacaacattcccaataaagcaaaacaaattagcactgtaaagacgggttatttttattcatgtcattatcaaagtagtaatttaataaagaagaattcaatggtacaatctccgaaaataaaaggggaaatggtgaaagctatgaaaatgaacatccgattatttttaccgcagtcactgatatcattcaaagaacatattcaacttgtaccaacagagcacttattgatgtctctttttgctctgaattaccaaaggactgattgttcaacagagaaaatttagaaaacacagaaaagcaacaggaacaaaggtgcctcaaaataactactgttaatatatttctacataaagcatttttctcatatatagagagaatattaatatatttgcatatatttatattttaaaacatatatgatatggtttggctgtgtccccacccaaatccatcttgaatagtagtttctataatcctatgttttgggagggatccagtaggaggtaactgaatcatgaggacggttacctccatgctgtcctcatgatagtcagtgagttctcacgagatctgatggttttaaaaggggcttttcccccaccttcgcttggcacttcttgcctgctgccatgtaagatgtgactttgctcttcctttgccttctgccatgattgtgaggcctccccagccatgtgaaactgtgagtacattaaacctttttatttataaattacccagtcttagctgggtgcagtggctcatgcctgtaatcccagcactttgggaggctgaggcgggcggatcacctgagggcgggagttcgagaccagcgtgaccaacatggagaaacccatctctactaaaagtacaaaattagctgagcatggtggcacatgcctataatcccagctattcaggaggctgaggcaggagaatcgcttgaacccgggaggtgaaggttgaggtgagcagagatcatgccattttactccagcctgggcaacaagattgaaactccgtctcaaaaaaaaaataaaaataaaaataaataaattacccagtctcaggtacatcttattagcagcgcgagaaaaaactaatacaatacactttacttatttaaaacatcgtttgatacctattgttctataggctattatctttaagcaatatttcatgaacatattccaattcaaaacataagccataaagaatatgacctcttcctgcctacagactattgcattacttacttaattagtccctggctcttgggcaagtaggttgtttacaatttcttgatatcataaatttttcaagtttcctgtgtgtgctgtcaggccaatatttttatccaaaaatacagcagtggaggttaactagatgatctcttgcagcccattctaaatttattaccgaaaaacttgcaatttgggtaggatcaaaataaaccacaactgaataaatagatttttttcttcaacaataagtaagctccatgtagcaaatactttttaagtatgagaataaccagtaagtgcatgtggataagaacaaaagtgatattaaaagataaaaaacaaaaaccacctatcctacatcttagccctgtctcacaaagacaataattcttaattcctttaacagtttcttctgatagttgcttaatatgtctaatgtacctgatatttttagatttctaaatattcattattacctttgatttgtattatgaaaaataaggatttaattatcttcaaacattggaacctcttctcttccaactcctgaatagcaataggtaaactcaattgaaccaaaagatgccattccatgaaatgagagctaactgaatccacattttataaagtccttacagctacatccctaaagagatgagttcaggcatccaaaaatcttaatgctttagttcattttattatcactgaataggatattatatgtcccaatcataaaatgctcaattactgtaaggatataaacagacacttttcaacggaagacatttatgtggccaaaagacatattaaaaaaagctcatcatcactggtcattagagaaatgcaaatcaaaaccaaaatgagataccatctcacgccagttacaatggcgatcattaaaaagtcaggaaacaacagatgctggagaggatgtgtagaaataggaacacttttacactgttggtgagagtgtaaatagttcaaccattgtggaagacagtatggtgattcctcagggatctagaactagaaataccatttgaccgagcaatcccattactaggtatacacccaaaggattataaatcatgctgctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaagaatgagttcatgtcctttgcagggacacagatgaagctggaaaccatcattctcagcaaactaacaacaagaacagaaaaccaaacaccacatgttctcactcataagttggagttgaacaacgagaacacatggacatagggaggggaacttcacataccggggcttttcggggggttggggggctaagagagggatagcattaggacaaatacctaatgtaaatgatgggttgataggtgcagcaaatcaccatggcacgtgtatacctatgtaacaaacttgcacgttctgcacttgtatcccagaaattaaagtattattttaaaaaaagaaaaaggaaatacctatagataaaactacaacacatttgtggaaactgaggacaacctacaaaaataaacgttataccatactcacagaacagaagaattaattttattaagaaatccattaagtacattttctgaaaaaaaaaatccatagatgcaatcaatgattaccgtcaaaatcccatcaagtgttttgtagaaattgaaaactacattctaaaatttatatgaaaataaaggagacctaaaataggaaaaacaattgtgataaagaacaaagttggggagcttacactatctgatttcaagattaactataaatctatagtaatcaaattagagtgatacaggcatcagtggaatagagagtccagaaatataacttatatcatcaatgattttcacgaaagttgtcaatatgattcaatggggggaagaagaatctcttcaacaaatggtgctagaacaattggactttcatatgaaagaaagtgaacctggatcctagacctaaaagtaaaagctaaaactataaaacatctagaagaaaacaggtaaaaatcctccttgccttggagaaggcaaagatttcttaaataggacacaaagagtactagctataaaactaaaatattgtacctcattaaattcaaaagtctcttattaaattagtttcagtaaggaaatgaaaggtaagcacaaaccaggagaaaatatttgcaatacagttaagaactgtatagtgtctgagatttcaactgtatagagtctgagatttcaacttacaagctaagttagcctgttactatttcacagatgctggcagaaaacacaagactcctggattagagccaaaggacttcattatgcatgtgttgggtccctaacccacccagtcgcacggggacaatgcagggcccatggtgaatgcctgcacatgcagtggattgcatcataagagaagaacacaaagcttgggggattcaccatttttatagtgagcagtaataggcatgctcattgtgcagagagaggcaaaacctcgcctctccaggctactcactgcaaatgcaactcagaaaaatgggatgggtaaagagcaatcaaaccttgcattcttggcatagccagcaagtagatgtagggaaactcaggacccatggaagactgcctctcccaatgatacatttcataaaggactagtattcagaataaagaactcctataactcaatagtaataagacaaattaataaacagattaaaaacttcataacagaagatatgtgaatggccaataatcacatgaggacatgttcaagatcacctgtcagcagaggaattcaaattggaacaacaaatgagggagtgctacacagtccctatagtagtctcctagagtagtgagaatttgatactcctggaactcttctacactactggtggcatataaaatgatactatcaccctggaagatgtttgtttcttttaagttaaatatacattgcccatattactcagcaattgcagttactagagtagtgagaatttgatactcctggaactcttctacactactggtggacatataaaatgatactatcaccctggaagatgtttgtttcttttaagttaaatatacattgcccatattactcagcaattgcagttactagagtagtgagaatttgatactcctggaactcttctacactactggtggacatataaaatgatactatcaccctggaagatgtttgtttcttttaagttaaatatacattgcccatattactcagcaattgcagttaagtgttaagcaggaggaaaaaaatgaaaaaaatctacgatgtatggaatacctttattcttaatagttaaaatctgagaacaacccaagtattcatcaacaaattatagtataaccacacaatgaaatactatgcagcaataaaaagaattcactactgataaatgcaacaagacaaaggaatcaaaaaattatgctaggttgaagtagcccaaacaaaaagtacacagtggatggttctatttatatgaaaaaccaaaactaacctgtcaatcttttctctaggaccattacaattcaggcacagaagcagagctattaaatttggtgtgtttggctggaggataggattaaaaggaggcaacattttaaatagggcagcaagtagatttaaccaataaacactgggaaagacagactaaatccactagctaacgataattacttcagccatattgaactgtccaacttgaacaatttgttgcctcaaggattctgcattcccacctgagaatcctgcctctgacaccctccgcccttatccaaaccctcaccaccactactacaacccttacccaggcctactcctaaacattggttagacctgggctgagagtggcttcccacaaaaggcctctcgtgagccacgcaatgggtcccttcccccagtctatggattcatttttcataactcttactctgtattaaaataactttcattactacttattatttaaaggatatattgaacacctattgtgtgccaagtactgtttacatgatgcagacacaggagtgacgtaaaagtcaaagatgagtcctaggacttcagtctatgccaaaacatggtaccatctacttagatgggggagatagaataaagagagtgagtgataggggaaatagctatttaagagcctctagagaaaataatatcttttgttctaagaaaataacgcttgtgcggctaagcatggtagctcatgcctgtaattccggcaacttgggaggctggggcaggaagattgctagaggccaggagtttgaaaacatactgggcaacacagtgagaccccatctctacaaaaaacatttttcttaattaacccagcatggtggtgcatgccagtagatctagatactcaggagactgaggttggaagatcacttgagcccaggagtttgaggttgccatgagccatgatcgtgccactgcactccagcctaggcaacagagcaaaactgtgtctcaaaaaaagaaaagacagaaggaaagaaaatatcacttgtgcagagaccagaatgaagaggagaggacatgggaaagctgagaaaaagaacttctagcaaacagaagagaaaatacaaagccttgtggcaggaatgaacttggcatatttagaggacagtaagaagactcagtgaacacgacaagagttacagatgacaaggacagacagaaaaggcagggctccgatcctctaggcaggcagctgaaaaactacagcctgagtgtcaaatgtttttgtatgatcttggggctgagaataattttcacattttcaaatgcttgttaaaaagaagaggaagagaatgaagaggaggaggaggaggaagaagtgaagaaatcagaagcagcagcagcagcagatgcaactgagaccatatgtgacaaagtctaaaatatttactgtgtggacatttaagaaaaagtatgccatcccctgataggatcttataaaccatggtaaggactttaggttttattctgagtgggatggataagtattggagagttctgagcatagaaagtataagatgaaataaacattttttaaggatttttctatctactgtgtggcaacagacagaaacaacgtgaaacaaggaggtcagttagaagactactgcattgtctggtcaagagttgttggtagcctggcataagatgcagtgatggaaaacattagatgtcctcaatatgaaaataaattttcaatgtacagcagacaggaggctggtagtttagatataagaatgaaaaaagtaaactgtgaagatgatgtccaggtttttgttctcagcaagtaaatgaatactgtctactgatcactgtgaccttgaaaagacccgttttagtggtggattagggataagcctgatcacaaattcaagaagaaaagcaagaagaatggacaactcttaggagattttctgtaaaggggaaaaaagaactggggcagtggctagagggaatcctggggtataatttggggggagtgggaaaaaaatatatatatatggtaatgtttgcatgctgatgagaatgaccaagaaaaggaaacaaaactgatgacgcagggaggtaggtacaggctcagaaaaacaaacaagcagccaaacaaggtggctcacgcctgtaatcccaacactttgggaggctaagacgggtggatcatctgaggtcaggagttcgagaccagcctggccaacatgtcaaaaccctgtctctattaaaaatacaaaaattagccaggcgtggtggcacatgcctgtaatccaagctacttgggaggctgaggcaggacaattgcttgaacctgggaagcagaggttgcagtaagctaagatcacaccattgcactccagcctgggcaacaagaaactccgtctcaaaaaaaaacaagaaaacaaaaaccacttgagtagatgacagaggatgtgccctactatacaaggggagagactgaccttatacagctgcaaggaaagtttatcactgtaaaaagagcaaaagcagagtttaagggaacagattctggtaccttgtcagatctgatgattagaaagtgaggtatggcagttctattctgattacatcaacattctcagtgaaaaaagcagccatataatcaactaaaagtgagaacaccgagctgaaggtaggaaattgttttcaggaagtaaagaattgcaataaaaatggtcatgtggtaggatatcggagcactgttaagggcttgcttattaactgtggtcattcaaaaaacactagtcagtgtagcagctacctgcttcctcccagatgcatgctgtgctgaggtgcagatgcagaggagggggcaatttagtttaaccaagggcagggtttatatgaacgatgaggcaaacaaactgatggtatgtgtgagagtgaagatctgagggtgttaagtatataaggagagaagtaagggcatggcaggaacagggaggtgaggaacatgaaacatgtaaagtcaatgggtcagaattgccaatgggattgcaaaattcttaaagtgagggcactaagtaaataggaaagatagacagtgcacaggaaaggaagtctgtaaatcatatttagaagtggtattttactgtcccaggtgactgagattgggtgaaaaaacaaagttcactaggagtgataaagtcaagtaaatgagaaagtgggatgttggacagatcacatatgtgaataatgaaatcattagggatgatggaggtggtagtagcataaggaaaagcaatcaactaggtagcccagtcttcaaggtataagaagtctgtcatacatgccagcatctctgtgtgatgccatcttctccactagaatacaccctacagggcagtgtctgcatctgcctaattcatcactgtaacaccaattctttgcaaagtgaatggctttcagtgaatgaatgaagttataataaaatggaaggtatacatagactaaggttaaaataagaaaagagcaaaggcgggcggatcacctgaggtcaggagttcaagaccagcctggccaacatagtgaaaccccgtctctactaaaaatacaaaaattagccaggtttggtaggatccatctgtagtcccagctacttgggaggctgaggcaggagaatcacttgaacccgggaggcagagattgtagtgagctgagatcgcgccactgcactccagcctggtgacagagccagactccctcttaaaaaaaaaaaaaaaaaaaaagaaataataataagaaagaagaaaagtcacacacacctcttaaattaaagaaataggaaatagaccagagagactatttttcaacacaattaactaccttttattatattactatccaaacacaggtatagaaaaaaaggaaattgagggggaaaatattatattacaagaataatcagaaatactccttttaagaacagctcttgtatttcattttacataacttcaaaggaagagggaagtacggggaggaaggaaaggatactcacggctgcatatctttaagtccattagccatgaagatgaaaatacttagaaagccttatcccctgtggtatcaaaacatattagtgagataaggatgtctgcctgacatcacaaaaattagaaggatatttatccaacataatttttaaatctttttaaatcctttagcaaattttattctaaaataccaaatgcagcatagaaagaaaagtacatagattcctcttatcatattctttattaaatgtattctaaggtacaaaaagtaatataccctttcccataccatttctgttcgtctaaaactaaatgctctttcttttgctaggtaactattacaggtaatagtaaccctcccctttgacctgtcttgaaaagattactttgcccctacctaaatgactacatttcatctcagttcaggtgtaacacttattcagtgtatgttcactcactattctatctcattgtttgctttattcaatgtataagaatacattgaatttctagttaccagttgatttttgaaataactgaatggtttttatacaaccataaagaatctaccatttattaatgaccagatttttaaaataataaatgtaaaaaaaaactaaatctgatatatctacacactctgaaagaagatgatacagcataatgccaatatcaatcaggacaatgaccttctttatctgcctaatgaagtatctaacatatggtagttgcttaaagcaaaagtttgcctagaatacctgtgatatcaaaggagtcagaaattatattcttaaacactactccaatcactgtagactgttttccaactcactaaatgataccttatttctcccagatagtagcctataccaaaattccccatgcaacatcttcaactgctggtgatagcttaatctttaaatcacacttaaacctgtagagaaaaccagtattttttttaacatgaaggcccataatatatagcctctagagattaaaatattaagatatcagagaactgtaagaatagtttgaactttaatttttaagtgaagttagttactagattctagatccttctccataacatttactttgtaattttaagcaagtaaattacagaaaacagaaaactgttatctacataaagcctaaatagtgaaaaagcttacgttctcatagtgataagagagttaaatgcactcttgcctgggtatatgtatctatctctatgcctgtaggtttctatttaagtcaataaccattaattaactgcctcagtttttctttgattttgcaattgctgaattcccagtacctactcaggtgatgagacttgtgaagaagaatgagatgatatgaaatgtcaagactatttaaagaaatagtttgcactggtagggacaatattttaagagcagagcagagtcagtgcagtacaaaacaagggtaagcacagttgctgccaagagggtaattataatctaaattactatcatgcatattactattaaaatgcattgcgactatttccttgcatttttcaaatgatttcaagcatctctaatgtcaatgatcaacagaaacactaagctgtcactgctgtatgaataactcattttcagaacatatacaaacagatctccagtgccaataaaatctgttattcacagataattttatgcaaacacatagtagaaactatgaaagctgaagaatattgcagaaaggtgcattcaccaacaaaataaagtttagcaagggattcccttaaagagttacttggctttttaaaaaaacatttaatgagtatcattacgtgccaaaaactctgcctataatttggaagctggttttagagtacattaaaaagcttaaaattaccaactatattttacccaaaaaaaagataaagtacagaaaatatgctacttccccccttttcacttctaaaatatctctataaagaacaattatagtgatctaatactaattttagacaattagaaattaacttgacatagcagaagaaatttgacacacaacattctcttattatccatcaatatttaaccagcacgacctccaatctaatggaaaagctgtcctgcattggcccagtgccttcaataagagagttgattatttagactattttacatatttaagaagtgttgcttcaactgctgaatgcaatactccagtgttataacacttctacctgcttaccatgaccagaactgaagtattcttttagctcttaagcctcaaaaaggatatactatacagataacagtctaatgtttctcccatagccagagaatactaaacaaaccatgatggaccacataatggagtagcatgcaattataagaaaaaaagacaatatctctatgagctgataaaatcatatcctagaaagcatgtgtaactagaaaacatgccaaagaatatctacagtatattaccttatgtttatgaaagaaagaaatgaaaaaatacacatatctcttcatttgtgcaaaaagacacaggaaggaataaggaactaatacaatcgcataccttcggggtggatgggaatatggtagaaaagatgaggagagaaaatttccagagaagaaagggggatgagagactaagtgacaattttttgcatagttattttttgtaaagttctgacttttttagtatagtcctccttgtatagttctgacttttggaaatatgttaatgtttcatacacttgaaatgagaaatattaatatcagaaagagtggaaggaaatcctaaaaatccaaacacaagaaacctaattgtatttcaaatgaacaataatgtcagagaaataagagtatgaaaatatggaaggctagaatgaaccctgtaatgttagactctaactaaagattatcaacatgaacttgaggtttttgaatatatataaaatacatatattatctattatctattttatatgttatatataatctgctataatatattatctagctatatatatagaaaagagagagaggagagagaacgagcaatagagacagagaaaggagagttggagggatacagatacatagacatagatagatgaaaagaagaataaagatgggtatgtgtatacaaatatgtgttttctatacatggatctacatgtatttcatatacacacatactcatgtacatatacacatatcacatacatgtaaatatacacccatatgtacttgtgtatttttattttattttatttttcctagctctgtctataagggcctagaagatataccattaaaagacctagcatccagatcttgaattctaaataacattctccactaaaaggaactacaaggaacttggggtccttggagaaatgtctgactccaaggctgggtgtagaatagtaccagatgatcctggaagacagtgtacaagacaataggaagtattcaaagaatgatagggacaaaaaaggacaaaggaactagcttgaagagacttctattggccaaatctatctgggggagtgggaagagatagggagttactacttaaaccatatgaagtttccttttgggttgacaacaatgtgctggaactagatggtagtgctagttgcataacactgtaaagatattaaatgccactgaattgtgcaatttaaaatgataaattttatattatataaattttgcccaattaaaacaagtttttcattcctcctaagaacttgaacaaggcaaggatgctcactttcaccacttccattcaacaccgtactggaagtcctagccagagcaatcaggcaagagaaagaaataaagggcattaagaggaagtcaaactatctccgtttgttgatgatgtgatcttatagctagaaaaccctaaagacttctccaaaagactcctagatctaatcaatgaattcagtaaagcctcaggttacaaaatcaatgtacacaaatcagtagtactgctaaatgccaacaacaaccaagctgagaatcaaatcaagaactcaatcccttttaaaacagctacaaaaaaataaaataccaaggaatatacttaaccaaggagatgaaagatctctacagggagaacaagaaaacactgcttaaagaaatcacagatgacacaaatggaaataacatctcatgttccagaattggaagaatcaatatcatgaaaatgaccatactacctaaagcaatctacagattcaatgcaattcctatcgagataacaatcccattcttcacagaattagaaaaagcattcctaaaatttatatggaaccaaaaaagagcctgaatacccaaagcaatactgagcaaaaacaacaaatctgcaggcatcacgttatctgacttccaattatacgacagggatatagtaaccaaaacagcatggtattggtataaaaggagatacacagaccaagggaacagcatagagaacgcaggaataaagccaaatacttacaaccactgatcatcaacaaagcatacaaaaacataaattggagaaaggacaccttattcaataaatagtgctgagaaaatttgatagccacatgtagaagaataaaactggatccctatcactcacaatatataaaaattaacttaaaatagactaaagaattaatctaagacctgaaatcattaaaattctaaatgaaaacctaggaaaaactcttctggacattggccctggcaaataatttatgagtgagaccccaaaagcaaatgcaacaaaaaacaaaaaataaatggaacctaattaaacttaaaagcttctgcataacaaaagaaatcatcagtgtaaacagacaacctacaaaatgggagaaaatatatgcaaattatgcatctgacaaagaattaatatccagaatctaaaagtaactcaaatcagcaaaaaaaaaaaccagataattcctttaaaaagtgggcaaatgacatgaatagacatttctgacacttctcaaaagaagatataaatggacaaaaaaaatgaaaaattgctcatcaccaatcatcatggaaatgcaaattaaaaccataatgagatactgcattactcagctagaatgatcgttattaaaaagccaaaaaataacagatgttggcatggatgtggtgaaaagggaacatttatacactgctggtggggatttaaattagtacaaccttcatggaaaacagtagggagatttctcaaagaactaaaagcagatgtaccattcgatccagcagttccacaaatcactttatcagaaagacacctggacacgtatgtttatcacagcacaatctgcaattgcaaagacatggaatcaacctaactgcccaccaactggtgagtggataaagaaaatgtggtgtgttggtgtgtacacatgtgtatgtatatatatacacacatacacatacactgtaatactacttggctataaaaaaagaacaaaatcatatcttgcagcaacttggatggatctggaggccatgattctatgtaagtaactcaggaattgaaaatcaaatattgcatgttctcatttataagttggagctatgctatgtgtacacaaggcatacagcgtggtataataaatactggaggatgaaaaattaccttttgggtacaatgtacactacccaagtgacaagtgcatcaaatcccagacttcaccactatccaattcatacatgtaaccaaaaaccacttgtacccctaaagctgttgaaataaaattaaaattaaaaatattaattagattaaaaactgttaatatgtataaaaagtatgacttacatgttctatatatgtattagatgtccagtaaaaattttttaatggttaaaaaactaaaaaatacaatgttttaaaaaaatttataaaatagaaaaaaaaaactaatttgtagtgttagaagccaggagagaagcagtcttgaagaggagaaagggtagtgactgaaacatttgagtttatgggcattattctatttccacagctagatactgattacatgggtgtgtctactcattgataatttatcaagtggtatccttaagatttatggattttactgtatgaacgtaatcttaaaagtactaaacaactatttttaaatttacaaatgtttcatgctttatgctatttataaggtacattcaaatcaaattcttctgaaatccttaattcaggtttttaaacataccacttaaaatactttacatagattatcattatatgcttcctttctgaacaataaaattaaataaaaaggtcatatggtgtcacacaggaccacttgtttttattttggatcttcagtatacctctagtattggaaaatgtttactctcacctaaaaaacaaattgtgatttaaagatttaaaggcagctcaaagttggggggtgggggagctgattaaacaaacatggatgttctaatttgccagcctctatttgatggttcattgaaggatgaagatgtgttcagcacatctgaacggatagaaaaaatccactgatattcttagtcattggttcattatcgtctttactgtgttgattatgtttatgtaaaaagaaaagccacaacaaaacttcattgggcatttaccaacaaaaggggaggagggacaagaaaacaccagctgttccagtctttaaaattaggcaatttgttttccaatccctccaggtaatcgcacaattatttgcctccacagttcagagtactactttcaagtgtcactgttacatttacactttaagtctgtcttccttttttttcttttcttgatttttggaagaacaccaccttgcctcttcatatgtacaagctagcctataaatgtaatctgtttatattagtaaaaagctcaaaaacataaacagaacaaaatctaattcactttctagattattcttcatattaataatagtaccagctaaatacaggcaaaaaataaatagtagagaggataaaacaaaatctttggatcattggatcacaccccactacaatccattatgggagtttggtctccgatttcctcagtataaaatgctcacagtggttatggagtggaagaagctgcaaaattgaaatatactgggaaaatgcctgcattgttgtcacaataagcaaatattctcttttatgattaacagtttttaaagctgtgcagtttatagagtaaagcaaaagaagaaagtactcacccatagtttgcagggtagggtaagggaacaacttgatcaaatgaatagatcaaaatgagaagcaactaaagtccaaccaaaagagttgtgttgttcatttgcttatacttcatcctctttgtaactaactggatagattgtctcatacgccttttatatttcccagaatcctgggcactattatgttctaaacagaaaatgtataaatacttcttaaataaaagagagggtaaaaaggataatagacctaaatttactcaactaccatgctcctaagaaaattcacaaacatgaaaatttaaaattttaataatatacaaaattatatctagtgattttataaattcataatttctaggatgttctgtaaaaacccagctatccacctaaaagatacattcaaataaccatgtaagtatctattatatactgttataataaccactgaaactcagaaataagaaaattctgcccatgaggtgctcatcattagctgagtaagaacatctaaacagttaaaaagtaagggatcctgtatatgaacctagtctctgggagcagaagggaagatgtcccaattgttgcctagaaggtcaggaaagcttcccagcagagatcctacaagaaccaggtcttaaaagaccaggattggaaagcagaataacaaaagcactatgggccacggcagagtcaggtggaagagctggtgtgttttaggagctagatgtccacatttacaggttttataggaagggagagaatagaagcacaaaacacacagaaacaagaaagtgaaatgtgcctacctcatactaaggaaaggagaccttaacccatggacaataggatggaactgcaaaactgattggaaatgaagttacaaaaagctgtatgttagaaatacattcaagcaacagtgaggaagactgagacatgagcctctccagaggcttagaaggttacagagacaaagaggcacgttcaggtggacatgaataaatacatcttctcagttctaccataacatttaaaaaaaaaaaaatcaagaaagaaacagctggaaaaaattgctacatttgatcacaaaacatgcccctccccccacacacacctcccacccccacatgtaagaaggaaactaaacacatctgacttcaaggaacttaaaagacaaaatacagggagaattgtttttcctcttaatagacgctaagcaaaggagcgtctctcaaacaatctaactcttctcaaaaatattcaattttctactatctaaaaaaagtaaaaattttccaaaacctacctttccaacctcatatcccactattctctttcgtaagagccttaactccggggggtgagggggagaacaactttccaatccagctatgcacaccatggttttccctatacaaacatctttactgcctacagcctcctacacaaccccacctccaaatgttcaaatcctatctgctccttcccaacaaaacctcttctaaccccctcggcaggagatagtgctgaccctcaaattcccaccttaggtttatttcccctattttatcttaattacttctaccttgtttcagtgacatatttagacattttatgactacaagattaaagactccttgagagaaagataaatgttgggtttatctttacctgcatctcagaaaacaggaactcaaaaaacattttaaaaaatttttgtaatccttgattaaaaccatattggggctactggttaaaacaagatacttacatccatttatccattctacatttgctggacatctattatatacaagcagtgttttacatgttaaaaatacaaaaatgaacaaaacctgcaaaattcctgttgagctctggaaatacatgcttgggaattttaccaatttactgggtaattctttccagagtagtttttttacgattactacttaaaccagtgtttctgtatactatttccttccaattacctttaaacctttacattctgacatctaccaagcacaacccctcatgaacatcatgaatgaataaggatatctgtgccagtagaaaaggtgaacatgtcagattcttaagttctgtggtactgtgaaggaacttgaacaaaaatacaggcatacctcagagatattgcaggatcagttacagaccatgataataaagcagatagatattacaaaaagtgagtcacgtgaactttttggtttcccagtacacagaaaagttatgtttacactatattgcagtctatcaagtgagcaacagcattaggtcttaaaacaacatacataattttaaaatattttgctgcctaaaaatggtaacgatcatctgagccttcagcaagtcctatttttgctggtgaagggtcttgccctcaatgttgatggcagctgagtgatcagcgtggttgttgctgatgattaaggtagctgtggcaatttcttaaaatcagacaacaatgaagtctactgcatcaattgactcttcctttcatgaaagatttttctgtagcatgcaatgctacttgatagcattttactttcaaacttctttcaaaattggagtcaatcatcacaaatgctactttatcaactaagcttatggaagattctgaatcatttattgtcatttgaacaatgtttataacatcttcaccagaagtagtttccgtttcaataaaccattttctttgcccatccataagaagtaactcctcatttgttgagctttatcataacattgcagaaattgtcacatcttcaggctccacctctaattctagatctcttgctgtttacaccacatctgcagttattcctccactaaagtgttgaacccctcaaagtcatcaatgagggttgaagtcaacttcttcaaaactcatgttaatgttcatagatagacctccccccatgaatcacaaatgttcttgatggcatctagaatggtgaatcctatccagaaggttttccatgagaggagtcactatctatggcagctccagccttgagaaatgtatttctttcttaagacttgaaagttgaaatgactccttgatccatgggatgcagaatggatgttgtgttcacatgcataaaaacattactctcctggccaggcacagtggctaacgcctgtaatcacagcactttgggaggccgagacaagtggatcacctgaggtcaggagttcgagaccagcctggccaacaaggtgaaaccctgtctctactaaaaaatacacaaaattagccaggcatggtggcacgcacctgtgatcccagctactcgagaggctgaggcaggataatcacttgaacccaggaggcggaggttgcagtgagccaagatcgcaccattgcactccagcctgagcaataagagcaaacccccaactcaaaaaaaaaagacattactctccttatacctcttcatcagaactcttggatgactaaatgcactgtcaatgaacagaaatatttttttaaagaatattttttctgaatagtaggtctcaacaagcgggcttaaaatgttcagtaaaccatgctataaacagatgcactgccatccagcatttgttgttccatttctggagtgcaggcagagaagatttagcatcattcctaagggccctaggatttttggaatggtaattgagcattggtttcaactttaagttatcagctgcattagccccaacaaaggagtcagcctgtcttttgaagcattaaagaaagacattgacttatctgtagctgtgaaactcctagatggcatctttttcaaatataaggctttttcatctatattgaaaatctgttgtttagtgtagccaccctcatcaatgatcttagttacaccttctggataacttgctgcagctgctacatcagcatttgctgcttgtgtcaccttgcacttttatactatgaaggtagtttctttccttaaatctcatgaaccaacctctgctaggttccaacttttcttctgcagcttcctcacctctctcagccttcataaaactgaagagagttagggccttgctctggaataggctctggattaagagaatgttgtagctagtttgatcttccatctgaaccactcaaaactttctctatgtcaacaataagattgttttgctttcttatcattcacatgttcactggagtagcacttttaattccctttagaatttttcctttgcattcacaacttggctgtttggcataagaggcttttggcctatctcagcgagttgacacaccttcctcactaagcttaatcatttttagcttttgatttaaaatgagagacttgggattcttcctttcactgaacacttagaagtcattgtagggttattaacttccttaattttaacattgctgtgcttcagggaatagggaggcccaaggagaggaagagaaacagaaaagagctggtcaatggagcagtcacaacacttattaacttcactttctaacatgggtgtggtttgtggcaccttaaaacaattacaaaagtaacatcaaagatcactgatcacagatcagcataacagatatacaaacaaataatggaaaagtttgaaatattgcaagaactaccaaataccaaaatgtgacacagaaatatgaagtaaacacatgctgttggaaaaatggcatcaataggtttgctcaatgcagggtttccacagtcctttaatttattaaaaaaaaaaaaaaaaaaaaaagcagcatctgcaaagaccaataaagcaaggcataataaaacaaggtacacctatattaataatagtaaaactacaactattataatacaactattataatttcttctgttcccaaatctgatcttatgttgcacttactgattgtttgactcccctaataaaatgtaagctacattagggtagggacatgatcaactttgctcatcatagtattcctactgcctagtaacagtgcctgaaacacagcaatatttgtcaaaagaaaaatgaatgaacaagggagagagagatgaaacaattccactaatttaagagatacactgctgttacagtatctcaaactaaagttcatgacttggagacatgacccatgtcaactcatcaacaaatttccatttctggagttgatctttaaaaaattttcccaagttcccagaatagtttataaatatgctatcttccaggccaactactaaaataactactaacaggagagaaaagcacaccaatcacagctttgagcaacaaaaaactggtgggggtgggtaggtaattaagtatgtttctaattttgaatggaaaatcaaggagaaaatacagtggccctgaaaagccattatttaatcattgttttggatgatatatttcagaatgattaatattcatgatgatctgcagaaacctacacatttcctacaaatcatatatatcaaaataaaatgtcatttttaataaatcatttcttcagaaacaagacaagaaaattcaagaaaatagtataactttcatagaagtataatttttaagtgtcatttgcactcaataacatgaatcataagcaataagccattcattaaacatgaaagtaaattggtttatccttgaaatactaccaccctcaaatctagtagtggaagtgcagtaattcacacttgcattaatggattaatttttttaataataatcaatacaacaataaaatttttaagtgagaaaaatatcctatatattataaatgttatatctaatttctgatgaaacaattacatcacaaattacagaatgtaacactcaccttcatgaattaatttgtatagtcaccatatcacaggtcatgattcatacttaaatacagtggtgttgctggtaaatgtttaacaaccatttctcagtaacgcaaaaacagtctaatattgtttgccaatctatgtgatgtaaatactcccagatggctgattacaagcaaccagtgcaatgtcactgaatgcaaaggagaaagtgaatctagaccaccactgaaggatatattgtgctagactaatttgtgtttgagatatactgtagttataaatcacttttattcatcaataacttattgttcatatgctacattccaggctgagattaaaaattacataatccctgccctcaatgaaattagaattcttgtgaaaatcagaaatggcacatgccatatgaattttaaactgcttaaaaatctaaaacagatatttattttttccatcttaaattggcaacagcttacattcattttagattgctcaatcatcaatctgatttcatacatatctcaatatcatcaagttaaccaaaatgtatcaaagtgacactgaattacagatctttcctaaaaggaactatatgtttatggaagtatataattggtattcgaaattatatttttcaaaaattattttcttgcctgggtgaggtggctcacgcctataatcccagcactttgggaggctgagaccagaggattgcttgactccaggagttcaagaccagcctgggcaacaaaatgagacccccatctctacaaaaaataaaaatgaaacattaggcaggcatggtggcatatgcctgtagtcccagctactctggaggctaaggtgaaaggattgcttgagcatgaggaattgaggctgcagtaagccatgatcacgccactgcactccagcctgagcgacagtgtgagaccctatatcaaaaaaaaaaaagaaagaaaattattttctcactgaaagtcactctatttacatcttccaatgcatttactcaaccaacatttattaagtcaaatatatacaggcctggtatatatacatattggataaataggcataaacatatctctttatccaaccaacatctattaaatgccagatacagccatggatatatacagatagccgaccccttgctaggatgaggagatacaattagacttagatatgccattacctcaagctaatttccttcacagtaagtctatctgccatcttcaaactatgcctggagatttattttaatgtttctccacttctttagtttgaaaagtggactgtaaatatggcattctgaaatcctttagtcataattcctgagagtaaccaaatctatattacccttttaatatggttttctaaacaattttttaactcttctttaatttgattgtgtatatttatctgatttttttcataaatccatagcaacacacttttttgcctagcttttctatctccttcccgtaataaagtaatccatgtaaaaagcctggtatatatacgcttctgtattttaatccctacagataaaatcctatataggtgtgtgcatgcacccacacacatatacacatagagaataattccattatttcttaatagaatcatcttatatgattttctgcagatttgcttttctcattgttcacctcatggaaattcctcaagttatctggtattattcaaattcattctttttaatatgggcatattgcttcataacatgaatagtcttaattcacttcaccatctccttttgtttccaattgtttaacagcagtgaataaaactgtagaaaacacatctttgtgcatatgtgctcatctattggtgctttcatttctacaccatagagttccaggagtggattcttgggtcaatgagaatgcatattttcttttttcatagacatttcagataacttaaccaaaaatgctatattacatcacagttccaccagccatgtatgaaggtattttttctccactagaaaagtaaagatactggtaggtataaagttactttaatttggatatccatactgtcagtctttacagatgtacttacttatttgaatttgttcttccattgacttttcagatccttagcccatttttctttgtctttttttttattccaacatttattttaggttcaagggatacatgtgcaggtttgttacttggataaactgcatatcatggggtttgatgtacagattattttgccacccaggcaatgagcatactacctgatagtctttcaatcctcaccctcctcccaccctccaccctcaagtaggctccagtgtctattgttcccttcttcatgtccatgtgtattcaatgtttagcttctgcttataaatgcagtatttagttttctgttcctgcatcactttgcttaggataatggcctctggttccatccacgttgctgcaaagatcatgatttcattcttttttatgcctgtgtagtattccatggtgtatacgtaccacatttgctttatgcagttcactgtggatgggtatttaggttaattccatgtctttgatattgtgaaaagtgctgcaatgaacatgtgcgtgcatgtgtctttatgggagatttatattcctttgggtatatactcagtaatgggattgctggactgaatggtggttgtttttaggtctttaaggaaacaccatactgttttcaacaatggttgaactaattcacactctaaccaacagtgtataagcattcatttttcttcacaacctcgccagcaccagttattttttgactttttaataacagccattccgactggtgtgagatggtatctcattgtggtttagctttgtatttctctaatgattagtgatattgagcacttttcatatgcttgttgattatttgtatgccttcttttgaaaagggtctgctcgtgtcctttgcccattttttaatggggttgttttttgcttgttgattcaagttccttatagattctggatatcagacctttgttggatgcatagtttgcaaatattttctctcattctgtaggttgtctgtttactctcttgatggtttcttttgctgtgagggtgctctttagtttaagtaggtcccaaatgtcaatttttggttttgttgcaattgcttttggagtctccatcgtaaaatatttgccaggtcctatgtccaaaatagtgtttcctaggttttcttctaagggtttttgtagttttaggttttacatttaagtctttaaccatcttgagttgatttttgtatatggtgtaaggaaggggtcagtttcaatcttctgcatatggctagccagtcatcccagcaccattaattaaatagggagtcctttccctacggctcgttattgtcaactttgtcaaagatcagatggttacaggtgtatggctttatttctcatttctctaacttgttccattggtctatatgtctgtttttgtacaaataccatgctgttttggttactgtagccttgtagtatagtttgaagtcgggtagtgaaatgcctctggctttgttctttttgcttaggattgtcttggctattcaagctcttttttggctcacagaatttatagaatacatttttttttctaattctgtgaaaaatattcttggtagcttgataggaatagcactgaatcttcaaattgctttgggcagtatggccattttaacaatattgattcttcctattcacgagcatgggatatgtttccatttgtttgtgttgtctctaatttatctcagcaatgttttgtaattttctttgtagagtttgttcatgtctcagttagctgcattcctaagtattttattccttttgtggctactgtaaatgggattgcattcttgatttggcttttctgttggattttttttttttttttgctctttttttctagccaagtcctaaaagcccactgcagggtattgctagcagctctttgtaaaaatcattagaaatatttcttaccagatctattatttgtcttttgcctgtgcttaatttgacataaaaacagttttagggtttaaaaaaaaaagttgatcatgtctatgttttattttagtttcaagttttcagtttttggagaaaactgttctgcagtctgcaaaaaggacatcaacatccagaaagaggccaagggaagaagggagaaaatgccctggcatcggacttcattctggtgtcattccaaccttaccccttcccttccagatattcaagccaataaaatttccctttttgctcaaattatctcaagttaggcttctgtcactgacaacaaaaagaaatctgactaacactgccatatacttacccaactgaattgttgagtttgatacactgcggctttatgtcagtactagaaaattggtattatataaattattttccattttcactacccatgtcagtattcctaagtctccacatgtttatacaaagaacatatcattacatggtttattttgagagaaatggaattgaattatttcttcatgtacaatagctaaagcttttgaaattgatgtataattgacattattatttaaattattcctaagaaccacagtaataatacatttagaatttccatttgacaaatgtttctttttcttaaacatgcaaaatttttattctcacttccactcacccaaaagttatggatacaatggctaatacttaatttcagaaaatacttcccattttacgtgtttattctctagccttaaccttaacctcagagtcattattgtgttatttacagattgagattgttctgacctatttgtagccaaggagaagttgaccccaaagtttccatttctcttttatcatcttccttttctgattgctgtactcctctcccatcaggacagacaatagcagtctgcattgcattcctcagagttctaggattcagaactgactgtaagagagttgaccgtggcttctaagtcccactatcctttttcaaacagaatagcttcatatttatccttcagatatagtggggagggaggactgtgtaagactccatttttacagaaaggtttcctgcactaaacagaatttaagaaccattattctgcattattatttgtttatattttccaatctcaaatgggccctcaaggtagctttcagatatttttatcatatcccatttccttcaatgcttcttccaaacctatgagcccttctcaaaactatcctgaaatctgctccactctgaacacataactttgccccttacttcactgagaatagtgaagctacatagtatgaactggttcaaacttcttctttgtcaaggaaacaagttttcttctatctatacttgatccctctgcccagagaaatatgtgtgattccttatttttaaaacttttaaccctaaatctaatctaatcaatctaatctaatcaatctaatcccaatacctatttgcctcttttatcttcaatctctttctccctagtgactccttttctacaaacctttcaaccactcaccctctcacccaaacctcccccaattctgcttcccatcaggctactaattcatccctcactgctaatcaccaaacatctgagcagtgtggggcacattcgccaacccccttcctcactagacactcaattcagaaggctccatagatttggttaccttccacatgggccctctcccacggtagctcttacaaatgaccatcaggaacctcataatctacaagtctcttctcgatgcgcatctgccaatctcctgaagcaagatactttgtgttttcctacctgaactgccctcttcctagactatctcatctaattcttctctacctctctccactgtacctatagatgtagatatgcttgtagcagctggtcgttgtcctttcatgagtttctcctcctctacccacttaacagacattttcactatcactccatcttttctctcttcttgctaagttaacttcattgataagctttcatacatgcctttacacacatgcacaagaaaaccaatctatagcaggccataactaattttattaatttcaggggaaaatgtgtattccttgctcttctctatcagacttaaactttcatatatatgaacattaaaattttccttgaaatggaaaattggatagtaccaagaaacactagattacaaatgtatctttatcaaaatatacctcatactgcttactataagttatagttactaaaggtctctaacaaatctcagaataaaaagttgaaacacaatccagacattattgaaaaaaaggagaaataatatcagaaataaggctgacacttaaaagataactaaagaatgcacctatgtttagtactgctagatgctttaacaaatatatctgccagcctacacacataaagtaatattcatttattcttcacaacaaccatttgaggttggtgtcttcaatctcattttcaaggactaaaaataaagtaaccaaaaatattaacaatagttacctctgggggagaaattatggatggcttgcattttgttttgtgtattttctacaatgataatatattacttttgaaaagttgtgttatgatgaaaatataggccgggcacagtggctcacacctgtaatcccaacgctttgggagggtgaggcaggcagatcacctgaagtcaggagttcaagaccaggctggtagacatggcaaaaccccatctctactataaatacaaaaattagccgggcgtggtggcaggtgcctgtaatctcagctactcaggaggccgaggcagaagaatcacttgaacccagcaggtggaggttgcagtgagccgaggcggcgccactgcactccagcctgggcaacagagcgggatgttgtctcaaaaaaaaaaaaaagatgaaaataccaagttttcaactgaatccttttggaagcaagaattataactgggtggcatttcctagtaaatgaaggaatgaaagaactttgcaaaatggaaagtaacttagatgttatcaaatctagtcctctaattttttagattaaaagcaatccgtttatgtaacattaaataaactctcagatggacaatacataaattcttcaaatataaaatcatacttttcatatattttaatgtagtaacatacctcctttatgaggtaaatatcccagctgcctctatttttcatttatggtgatatttatggcatccagcattgtaacacataggtaaatgcttaataaacactatttgacaatgatcacaaactgaacacttaaattattcacagatttacccagatgtttccaagactttaagttctgtaaataaaagttactaaatgagtgccaatttactacaagaatataaaatgaatttttgtgctattccaagtcacatttaaaagctttgcaaacagcatgctattagctctgctgatttgtttttatttttcctaattgaaatgtggtccatgttatcaggccatctgcactgtggcaaaatgacctggtaaacaagacaaaaatggtgttctctgttaggaacaatatcagattctgtttctgctaagaaaacattattctaaagggatattttctggtactaatgctgaaaactttgataaaggaggccacagtaggagatgcttgttgcagtgcttaggttgcctgctaagatgctgacgacaatccagggtctctcccattaactccaataagtcagagtactgcattttcaacactgtcctggcaataattcagcactttagcacatacttagggcccatatatcacattgtactcctcttacctgcttatacattttgtctctactaaactgtgagctctctgaagtgctatagaccttatcttattcacattaactaccccaagtttcttgcatttaacagaagaaagactggattattttaggctaaaatcaaggagcagtcatttatgcaatggtttacatctcaccactccagaagattgacgtgatccgagggatggctgcccttcctattcctctagctctttataccacattatcctttgtgtgtgtgtgtcaaaaaatactatcctgagatatgcaaaaataccacaataaaaagtcacccataatctcactactcttttttaagtacacaaggaaatgaaagttcttgccccagtttctccagccctagtgcaagataatcactgcaaatgcttttacaagtttggttagaatccatcaagggttttcctttacatgggcagatatgcacagacacccactcattcacagtataaactcacaatgtctttaaacaaaaattggttcatactatacatatgcttttttttttaaatattgggtaactttctaagtcagatctaagtcattggttttaacagctgtattatccatcaactgcatgactgtactataaattacttaatcatgtctctattgataaatattttggttttaaatttcctgacatttcacacagtgctgcaagaacatgctggtacacagatctttatatgttcaagctattcttataaaataggttcaaaatagtggaaccattacatcagtagggtatacaagtttttattttgatagatactgacaaattatactagcaatagtttgcattgatatatatttctatactctcaccaaacatttactgtcaaaaatctttagtttttctattatgacagacaaaaaatgctctccatacctattttaatttacatattgaaattgaacgtcttttcatgtggatgtatgacattcattatttttcttgggcaaattgcctattgacatgaaataaacttcttcctattgggttgttcatctttttcttaatgatttgtaggtgttctttacacattattgatacatagcaaacgttttcttccagctttttatttcttctaactttgcttgctccctctctctctctccttcgctacccatacaaaagtttttagttgtattagcaaatgtagccatcttttttcccttatgacttctggattttaacctgctcaatagcactctctcacttgaagattaattttggtaatatcatctcaggatgatagtgtaattttcagataacttatctagcctcataaagtaagtttttctttctcaagagacagaaaatattaaaacctcagtcttaattatgttaaagtttctcccctttctcagtgtgaacctcactcaaagaaatctatagtgatgaacggggctgcagatcttcaccattttcccaccttgtacttccattccaccatgccaacttttcaggtttcctccattaccttcagggctggagacagtggggaggaaagagaaacagatgcagaaaactgctataatcaagcatcactgttatactctggtgccacggtcctccagatgtagctgatatccaagtgttgaccgtatcttccatggaatgcatatgtgcattactcagacagtaaagaaatactactaaagaaatagcagtccaccctgcataaactgtccctattgggggtcactgcacatgcagggggtccccttgggacaaaattcctcctaagacaagtcacagtcaatgccttctgaaagatccacatctgaccaatgttttggcacaagtccagcttgttccaaccataagtctaatcctttttctttgctctgccaccaaagcagctcgaatagcctcttgcctttagaacctagcagagtgaacacagtaagtttccaatctgggtctccaaactggaagggatacacatcaacctctgagtgcttctctcaaatgcccactcatttggctccagtccctcacaaggggtcagaaataatatcacagcattccgacacctctctctccgaagaaaccccctctgtcgatcttccatttcttaaattactgtgaaccttatcttgtatagtttcaaagtagatgacaggctaatggtagcacaataggctctgcagtctcttttcatggctgtgttgtttcagcacctgatatcctcagcccctgggcttctgtcaaaacgttgacataacaggaaagtcatatttaatttttctgttatagaaatcttagttttactgttattaaattcctatataggctgttcaaaaatcaaaacaaccttaatattagagataaatgcctcatctttggtaggatttttatttctttcctcataatgtcttatactttctaaattttctgcaacaatgaatcacttctgaaagaagaaaaaaagactgttaaaactgttgtattttaaatacctttatttggcacattacccactggtcacaatcttaacttggattttgccactaatcttaaataagcattatacaaaagtaattatttaaagacattttattcactcatttatcttgttacttatttattgggcattaaaatgatatctgaattctgatcatatatcagaagtattacttctatagcactgttaatgtgagaagtatatataaatcatacacctttttcacataagtagacaaaacaaagcaataaaatagtaacaaattatttcacactaaagactgcttcattaagagatactctattcttttaagttgtatctttgattttaataattttaaatttgagtatatgaataaatgaatgatacttggaatgttacttgattactaaacaagttatcttagaatttctaatcattttattttgattactgaaacaacctttgtgtcctaaaaaaaaaatcctcaaaaatgacagggggaaatgcgtaaagatcacgagctataaaatctaaatagtgcaaaaataaaatgagaacactagttctcatctaacttctctaaaacataaccagacaagaagtatactttaggagagatacattttgccaactataagatattcccaaatcttaaattataattaacttcagattaaattaaggaaaatcaaaatatgagataatatgagcctcccagtaaaatgacccaggagattacacgcacacacagttgcaccaatatcagaataaaattaatttatgacctcaaaataaaacaaatttattttagttgccataagaaagtatgactttatcaatttcagagtactctaagagaagtgaatatgtgttacaggaggaggcagtctgcatggtacctgcaaacatgtccagagacctaaagtgctgcaaaataccactgcaactccccaggaaagggagtattcagacacataaacacaattatctagtttttgctgcagcaagatttctctgccttcgtggagcttctagtttatcacattaaagaaagcacatgatgctgggtgcacgcacagtggcaggatcttagtctaaatatacgccccattatctccacagtggatcatccaacaaaccaagtaagcaactctctatcatttggcttcctgtgtagactagcctataaggagagaagagactacaagagtcttcttaagaataatatttctgattgtaaattactaaagtgacatttggatttttaaacatcagtctccattaaaacagattgtatacctgctcatgaaatgaaaactgagtctttgtatgttgaccaatcaagtttgtgagcctccaagatccccatcaatgtgaataatgaagaattcacaaaagtaatactcttttaaggatttattttgcctaaatgacacattacctcagtacatgtcttttcctccaagtgcaacacaaaaagggagaaccaaagcatattatatctcactcagtgccctcaactactaactcaataggcaaaaagggtggcaatgctgaagtcaaaacagcaaattcaaactgaatagttaaatgtgactaaagagagaacaggagctggtttgtggtataagaagggcggaactagtacaggcaaggcaagaacaaaaaaagacttgaagtgggcaaggtggaggtcagaatgaactttggagaagtataatggttactgcatgtttgcacatgatcccagaacatccctgagggaatatggttaagttcagttatacaggaaagaatagaatgggtcattcaaagttaaaattcaggagtagaaatggagataatttttagaagaaaactaataaaaggaattatgtcatgaatctaacatacctaaaatatgataaaaattaaagagagaccaaactgatttaagaggcaaaattttcagatgaaatattaatacattattttatttatattttcaattcatatatatttgaaataaaatctatattacatataaaataacaaatatgaggtatagacaaatacatatatattagcttagtaacatataatcaactttttaaaaatcaatggggtgagagacctaaaatttttggatactactagacctaaaatacaggtgttaaactgggaggttctactaaccttctagatatagaaagaacttacatgaatgaagccaggattagaaaagcagggctaagagatacagaaagaaccgatccttaggtcatttgagaacccagatctatgcgtgctggaagccaataccaggcttctcagatgcacgagccaatatgctctgtttttgattcagtttgaattcagtaggtcatttctgacagaaaaaagggcagaaaagttaactgagggaaaaataaaacaagttatagaaaaatatatttctatgaccccattggggaaagggcagaaaacaaagttcaccagaaaaaataaagcatgatttatttaagattccagagatagatgttcaatattaggctttccattattttataatacatagtaagcaatagatgctcaaagcatactgaaggctacacatctacttccataaattgaattctgtgaataccaagagttgactttttgtacccctgtttatgaactgttctgtgttcattaatgtaatcatatatgagaattaaaagaaagaatattattagggcttaagaaagacaaggttagggtaagttgcttaaaaaaacttatcttaaaaattaggtataggtttaagataacaaaaaaatcacattataaataccatatacatctcctataagtctaaacttagattgctttacgagtataaattattggtctactcaaaacatacacaaaaatggttatcacagatgatgtcttatgggcatgtcttatgtgggaaaaaaaaagtaagagccactcctactcaaagaaaagggtttggctcaatatctaaagacaggttgtgaatacatacttgtatatttcatgtgcgggaaaaatattatatgtgttattttttcttatacccagttttattaactttttattcaactttttattacaaatatgaatcagatttaagaagccttcaactgtaacatttattttctcaggctcattttacactttacttgaacttggattagaagacttgaactgttaagactttaaacctagcccctattccaaactttcccacacaaaaacccctaaattttataatttagttaaccgagtcctagagaaaaataatgaattttctgaaaccacaaagttagaagcaacaaagctagattcttaactccaggaaacaaagtatagttttaagggctaaataagttattataaaatattgaagaacacagctttaatttttaccatctagaaaaaatatattgtattttgttcctatttaaaaatcattaatgttgttacccttcaaacaatatttcagtgattttcttagtatttaaaaacagtagcaaaatacaattactcaccatttttctactttattttactactctatatataataaagccctaatgtccgtaacattctacaatgtgttatagaaattgatgagtttaattacttaatgtgcacagatcaattagaaataaattgaaaatgaacatactgtacactctacttaatctcgttatagtttggtttcagaattcactttctaatttgaaacccagtatgttacattttaaaataataattagaaaacttttacatttcagctaaaataaagcaaaagaaattaaggtaggtaaagtttgattagtcaagaaatctgaactcaagggtaaaaaagatcctatgctcctataatctaagccaatacgtttgacttgtcatactcattttttttcttaaaaatggaatgaaataacattacattttctgtctataggataatttttaaatgaattataggcacaaaaggtagacaaactaatcagcagacaaatgaattaacaaaggaaataatcattcagtgtcaactctatatacttaagacaaataatacacatttatccaaagtaatacaagtatctgcacaaggggtcacacatcacttttcacattactgagccattttaaaacagaaggtgataaaaactcttagatgcctatgaactcaatttacatggagtacatcactatgcttttttaaaatgcgctcatattcaaatctgagaaacatgattctgagctcatcaggcctgcttaattgcactaacatctgcaatcaatttaaattctttaagatagtctttcacagtgcttgaagtgatttcctgctgtgatagatttaacacactcactaatttatagacatatacaagcagatgagacctatttttccaggggtggggtatagtactgaagggcagtctgaatttcccaactatcaatgggattcagaaagggatgcatcctgcataactttgaaactacataaggaaatgataacactgcataagcatagcatagaaattaaacttaaaactatttgtaggtcatggaccattaagaggtttaatgaaagtttatggatgaaataacagcaaaaccaagagctaacagctaaaagttacatagaaaaatgtcattattttctaccctaatagttagggcagcgggggtgctaataaccctgaattgttttttaaccaaagacataaattggcatagaataaagaaaagaatatgagattcaaaatcagagactagaggagctaggcagatggcagcagcaatacagttttgaaaactccctgatctcccacaaaaaaagacaaaataactaagtagcaaaatcaaacacccaacaatattgagtgacaaagtaccttctcaacaatcctcaaactacaggaggttgaagacaaaccaccaacagccacaaatccgcacagtagcaatacgtgtatgggaagaaccaaaggaaggcaacagagtagctaatgaacatgaaaacaagataactccaaaatggcccagagatatccattggacatctcagtagaccaatttgaaagcagcagttggaactggaaggagtatgagtgactacaagaggcccagaaaagatctgaaggggctggagcactcaatgtcccatgagttgccagagctccttccagaacaggatcctacattgaagagaaagtgctgaaagtgaaatcaaaattgagcagaaaattcctgtaaaagatgaaagacacctcaaagacaaacctataaatcaaattgtaacttacaatttcaaagtgagctaacagacattaagagaatatataagacatgaaaaaaatatttaaagtggactaagacacactcaaaaatgcagtgagggaattcaagaaaaaaatagaaataaaaaaatcatttcagaaataaaaactaacaaggaacacaagaataaacataatgtcataagagaatgcagacatgaaaaaaataaaatgtttaaaacctaaatagaaataaagaataagataaaaagcatttgggagaagacggcatattaaagatagacaaaaatccaacatacagataacagaatccatgaaaaagaaaaccaaagcaaaaaattagaacacatcagtgaaaaaaaaagaaatttaagaaaaaaagaaaaagagcatactgcatacttgataatcctaactcagatatcccagagaaagaaagacattaatttataactaaaagttagttatcagctgaccttttgacaacaatgccattaagctttttgctagaaaaaaaaatagtattattcaagatcctatagtattattcaagatcctaagcaaaaaaacgtgtgagccaagcattttatatccaacaaagctgactaaacaataaagggcatatactattaccaacatgcaaaactcaggaaatactgtttccatgagtccttcagaggaatctactaaagaagaaacttcagacaaacaaaaagtctgcagaaataacataaggaccatggtgagcattcaaatatagttactaaatgaggttaaaactaaatgagaactaaaaggaagagtgtgaaatgtaatggctatatgcttagtcaatgtcgacatagtaggacaaaaatagcagttggagacagaacatatgcaaaataaaaactttttacatacacatccacacacgcttttttagttttctatttctccactaaaaacagtaattaaacaaaaagaacagtaagtatccttggccctcagcttgtaaactttgaaatatcgttccccaccctaaaggaaagagtcaactgataccaggtctagcgggctaaatattctagaggaggagcttgatcatcagatcaaaatgactaggagccaactagacaagtcccaatggccaaagatgggacaatttgatcttcactaaaaataattgtaacacatcaatttttaatgatattaaaaatgattgatcatcttcagagaatgatagagaatgaaatcaatatattgaaagctggcaaataaaggaaaagaatcaagcatttatcctaaatttcctatatcactggctaaccaaacagtatttgagagatgtctctttgtaaaagtatcccaataaatgaaaatgaaattatagaattctaactgcaaactagatattaatgaaagaatataatacttcttatgatcttggtaaagagatgaaacctgagtctgatcatgcctctagatctagctgtctctgtgcaggaaatacagaggataggaaaacacgttaactttaccacaaatacacacatcagcaaaattcagaatgtcctggataaaataactgaagattaaacaagacatagagataatccaaattttaaaatataagcaacagtagtgcatttgtggcccccatggatctatcacttgcttcaacagtgattggacagaatagaccaagggactccctctcaaaaaaaaattttaaataaagaccaagcacggtggtgcatgcctataatcccagcactctggaaagctgaggttggaggatcacttgagcccaggagttcagtattacagtaagctatcatcactactgcactccagcctgggtgacagagcaagaccctatggatggacagatggatggatggatggatggatggatggatggatggatggatggatggatgaataaactatagtctgaggatgcacttttgagtgatagatagatagacagatagatagatagatagatagatagatagatagatagatagatagatagatagaaagaataaactatagtccgcagaggcacttttgagtgataaaactagaaagaaactcgaggaaatgattcccataaaagtcaagatggtgattacttttaggctaaaatatacacaaaactgaagaaaggtttagcatgggacggggcagatggagggctttccaggatgactggcaaggttctatttacttatctgtgtggtattctccttatgataattcattaagctacacatctttttttgatgttttctgtaactatttttattcgacaaacggtttttttcttttctaaaaccctagtttctagtcctagctatggcattaatgtgggaaagtcacacattcccttggaccattccctcatgtgcaaaatttaaagatgctgtaagatatcttccagacctaaataaaaataaaaaaaagaactactactaaatatatctactaaatacgagagtataacaaagtcatccttaacaaaaatgcagaaaaaaggttttaaactcaccaaagtagcacaaagcagtttcccaaggaaaaaaaaaatccacaaataaaatctaccataacagtaatatacaaggaatagtcaaaacctaagattaaagttactgttggactatttggtttccacatctcaacaaatcctaaggacagatccttaatttacttaatctactctggaaggccttctggtaataaaagcatttgaaaaatttttgcagcatattgatagtaagaggctataccaaccatatttattgtcttgagggttgtgggggaaaccactacactgagccggttaggaaatggtaataagtcaggaaaccattaaattgggaacaaatgccttttgggcatcaaggtgattgattagcctattaaggatttttttttaagtatgtatagaatttatgccctttaggaataactaagaaatcaaaggatatctcttaagtacaaaagagcttaggagtttaagtttaatgccaccaactaggaaggtgagtaaattcacggaagctttaaaaccaggcatactcttctccttactaatatctgttctattgggcatctttttccaaaagaaagcaggttcttctctgttacaatagttaaccttctcctttgattatttctactagtgaccaaatgtcatagagaatttcttagcagctactagtatgtatggtacttgaacactcattttgatgttatgcatatggcaaactatccttgaagccaccatgactagataatagttttaatagtaaatggtccatgcttagcctttaaattctgtcaattcctggtctcttgttaaattaatgttatactaagagacatctggtgataaggctcatcttctgcagcccagtaattctcattctcggctgtatcctagaatcaccaggagggctttactcaatattgatacctgggtcccatccacaggaactgttttatggaagtgttaagtggtaaggcctggacattaaaatacttaaagttcccagatcattctactggatatcaagatcaagagttattgctcctggatactttttcctcatttcatcaattacttagcccctttgttcactgaaagacacctgcacatacatagcatttattttcttaaattttcactttttccttcagaagtgttccttcttttaaaagcttctttatatttgtatatacagatgtcacatgcctcttgtggcactttcaaacttatcactacattcatggttatctgacatggtaagtttttaattatattcacaaaaatctaaaaagtaagtacgagcatagcaaaatgtcttaggccaagaaacaactcagtgacaagatgaaaacaactcagtgacagggtgaaaatgaccttggatgacctctaatgccaacaagcggtataaacatcattaaccaactcaggatctaataaaattcaactagtaaatagcagtttttccatatctgatgaagccttttttaaaaaacgctataataaaagaaaagctgtcttaactacctatacgatttttaaaagaccaaaagtatacaattctaatgtgagcctaatataatttactcctataaaaaaagaaaagatgatcagtttcttcattatcatctcctacctaaacaaaaacacaatgcagtaatactagagaacatgaaacaccactggtgctgcccagaaataactcataaggaatctggatgaattttagctgttggaagatcattttaattgtgcatacataaaacctaccctatataggaataaatgaaaactgaagtgccagctagattattagaaaatactcttaacaagaaatcggttcattgtgctgaggctctgaaattttctgctagtcagcaagtaagacctggaaacaagcaggcaaagcatcataagcaagggcattgtgtttattagatacatctaatgtcaatcacaaattttttactaagcttttgtgttataggggcatttttatcaaatccctaatcggaaatagaagcaaaaaaaaaaaaattcacgttaatgttaacaagaatgtgtgaaactttggttcttctaagtttctagtggttaaaatataagcctcctttaagtaagaacaaccaaaaagtgagagaaaataaaaagaacttaatttacttgtaactgacaatgttttccaaaattaacattggaaactgtaactgaaagcaagaaaaactgacactgaaatgtattaaaactccctactaatattacaatattaacaaatcaatgctaaaactaacaaatcaattccagattttccatgtagagaaaatacagtcaccccttggtatccatgggagattggttccaggacttcccacagacaccagaatccagagatgctccagtctctgataaaaaatggcatagtatttgcatataacattcacatcctcccatatactttaaatcatctctagatgacttatgatacccaatacaacgtaaatgctatgtaaatagtcattatattgtttagggaataacaagaaaagaaagctgtgcatgttcagtgtagacacaattgtttttccaaatattttcaacctacggttagttgaattcatggatgcaaaaccaacccatggatacagaggttcgactgtatacataaatctaaatatatgactgatttttctcaaaacatagttcttttctgatcaagatacgcctagaagagtaatactgcagaatacaatgtcttccatccttgagaacataatggcctattgagctagagcagtactatgacaagacctttcaaaatacttttaaacactatattatacatatatccatacacacaaatatatacatacacacaagaaactataattctacacttatgaactcaatttagactcagttgtttcattgtgttgcttaaaaaacttttgttagtctttatgcctcgtaaagttatgatcattaatacttgatatttaactttcacatttaaaaagtctgaggaagaactactacagtaatacttaaggaagcgttcaaagaataaaaactttatccaaaacttttctaataaattcctcagaatagcccttacattcagttggaaaccagcttgacagggaaaaagaaggagctagcaaactttcaggagcatttataaaagaggaattctgcttcttgatccaaaatatcaaaaaaaaaaaacataaatagaaaataaagaatggatgttctaattaagaatcttagaaatgtgggatgggctatccttcgatatcagctcacctaaactgggcatgttaatgcagctgtaatacagatgccaatgatacgtggataagggaggtgaggagtctatcacaacttctgactccaagctagtgcattcagaagggcttttaattagaagtacaaagttcaaagagaaatgtttaaagcattttatctaaacctaatggtacagccaaaaagtaaggggtggggcacgggggagtgcaacatgctaagaggtagcagtccagttgtaatctgtaggtagttaaactgtctggacagtttaatcatcttgacctacgaaaattaattggggaaaaagacaactcgcaaagcactgataagcaaatgttcatctctactaagtattcttggagacacaataaacacactgcactacataacataaaccaaaattcccccgaaaatctctttaaatatctctccaaatctctcccagaaaccccacctccccacaaaggaccagacatctttttggttctcctttcctatctatctctcaaacttgtcctccttccctctatccttactccctctctgcccctctgcttccttcaagaatctgctgctcctttcaagggtctgctttcacttgtctggaatataggttttggcctctcaggacttccctagtttcatattgccgcagattacccggacaaacctgaaagtagaacggcaaatagaagactccttcctctcaacagataggaaaggtataatgtatgtttatttttgaggggcggggagggggacagggtctcactctgtcacccagactgtactgcagtggcatgatctcagctcaccgcaacctccacctcctgggttcaagcgattctcctgcctcagcctcctgaatagctgggattacaggcctgtgccactacacccagctaatttttgtatttttaggagagacagggtttcaccatgttagccaggctggtctggaactcctgacctcaaatgatccacccgcctcggcctcccaaagtgccaggattacaggagtaagccaccaagcgcagccatatattttatttttactaaccctctgtaattgatagagaaaaaatatataaatcttgttcagaatagatttagatcaataagaatcctttttaacacatactttaattgtatataaattaatccatagtctcccatgacccccatcatgagatttttctcacattatccagaaataatacatccagaaacagctcacctttaacacaactcaagcacctacaagaaaataagcattaataaacacttctatcacagacataggtatgatgcaccatcccaaagagaaaagaggaaaaagaaaactaagtgaaggcagcaactctattaggatatatcttccatgcttggtttgtccactcaaacataagaagcttgactacagaaatcatcttttaacagtatctgatggagtactttaagcattctaagggaagataagattaaaaataatcaaaccctaataaagaatgagaactatactcaaggttaagcattactattaaatacatctatatttatataatagatttgtatattaatttctaattcttttttatttttaaaaataatgaaaatcctcaggcagttgtggtttacaagagcattctctgttctggtccagaattttcttgttcttacatttattggaaaccatggatcctcttccatttggcctatcacatcacatcctgctatcaaggcctttaccactaactgcatcacagtcttaccttccagctacgtgatctaacaagtcaagtctatattcttcttaaaagacattttctccaataaacttgctgttaaacatctgagttgagtcatttaccatagaatgggcacagcgccttgtagtacctctctcatctatgctatgagtgagcccacactaagtgaggggagcgtcttaaggatgctcctttgaatggaaacagtaatttccagattgaattagaattaaagatccagcacaggcaaaaatgcatgtggatggtatatcaggactctttaacagcggcaaagaaaaaacccggagtagcttccatgagaacctgcatcacttcacataatgaagagtctaggggcaggaatgcattaagccagagaagcagctctgtgacatcaagcaccgtacaacctctcacaatcacatccaatggcggaacaaagtggctctccaactctggatcctttcatgagggagggaaacctttctcaaaaaccccaaagtggaactgcccaccagagtgtaccggacaaacctggatcacgttcccatgccctgaaagttagaaaaatgtaaatctggtattttctgcttctaaatacgacacttccttaataaaattgtaatcattcttcctaactgcacaaattcagttttattcttgtgccacctaaattcaaacttaataacgtcttagaaataacctagtttgattggtggcttttttttttaattctaaaaaccaaccttatctacgttaggcctactttgagggttaatactttgagggttaagtattttcaaaccatgcactgttagacatcagtactattttcaaaaaaataatattaatgcttacccaaaaaggagaatctcaaagcaattctaagcctaaaaccataacaaaagtatatcttttttatcctgtgtccttttcatatcctgtgtagaacaatgtatccataaactttgattctgttcttttcagagtagctttttcaatagtcattaatgtaaataaagtggcatgacaaagtctgtaccctagagttaataaaatgtgtttctacttccagagcaaaaacaaatgactggtcagcttgaactttctagaatgttaaccatctgccaaattattcagaaccttcctaggaagagccatgatcctccacacactaattaaatgagtcaatgctgtaatcacactttagataactaatctatttcaatcctgataatttaattacctaattctggtaaacaaatttcaaccttagtccaaaatgattagaggattaaagttgaaaatcagtgaatgcaaactgaaatagatccacataacaaagttcaaaacagtttgtttcttaaaattatgtttattatctcaaattcaagaattaatatgaactatcatgccaaggttttctaaaccagttctaactgatgtcgtatctcttataataaatgaattcctacttgttagatttacaattccctaacagggtagtcttcactgactacacaaaacataaacactatctacactcaccagtctgttattttttttccacatcacatttcacctcctattacatatatgtttatgtgtttctgttatgtacatccagtgctgcttcacaggacacagtgatagactatcgtcacacaccatctctagtgcctaaaatgctgcctgacctgcagtggcacgatctcggctcactgcaacctctgccttatgggctcaagcaatcctcccacctcagcctcctgagtagctgggactacaggcatatgccaccacacccagctaatttttatatcttttgtcaagacagggtcttactatgttgcccaggctggtctcgaactcctgggctcaagagatctgcctcccaaggtgctggaattacatgcgtgagccaccacacctggccttatagacacttaaaaaacaacaactaaaaaaaagccttagaaatgtgaacttacaaatagtaaatctgtatttttactgatgtacttttctctatattttaaattatggtataatgattacaataacaagaacaaaaaacaaattacaaagaaaaacaaactattgctaccaccactgctaccacaagaggcagtcaccagtcataaaatatgttgtgttctaatcatgaaataaacaatttaattttgtttttattattattattattttagagacagggtctcactctgtcacccaggctggagtacagtgatgtgatcgaagttcactgcagcctcgaactcctgggttcaagcaatcctcccacctcagccacccaagtagccaggactatagtctctcatcaccacatccagctaatttctttttctggttgagacaaagtctcactatgttctccaggctgctctcaaactcctggcctcaagaggtcctcccaccttgacttctcaaaccaccatacctgcccatttaactctgataatgagtccactatgtaggtattcccattttatagtaaggaaattgagaatcaaagaggtaaaataagatttccaaggtcaagcagagacacataagcagatccaaaacaccagagctctgattcttaaacccccaataccaatttgtgatatataagtatcattaaaggacaaaggcaattagtatcagtatcatagtagcaggatacagagcccatctatatagagagctaaaaaaaggccgggcgcagtggctcacgcctgtaatcccagcactttgggaggccaaggcgggcggatcacgaggtcaggagatcgagaccatcctggctaacacggtgaaaccccgtctctaataaaaatacaaaaaatttccaggcgtggtggcaggcgcctgtagtcccagctactccggaggctgagacaggagaatggcgtgaacccgggaggcggagcttgcagtgagccgagatggcgccactgcaccccagcctgggcgacagagtgagactccgtctcaaaagaaaaaaaaaaagtgccgctaaaaaaagcacagtactcacagtgatttctatacctgaagagcaagctgccaaaacatgagacacgtttaaaaattaaacatcacttgtgtctttcttccaaaagaaaggcctcagagtcaatgactggtctagcagttaagtggagttaaagtataaataacttatgttcttgtaacctgaacttaggttaaaatacccaaggaaaactagtgtgttaagctactttttcctaatccaattctgttgtaaattgagccaaaatcattttccactgtctttctactgattgcttcttcattggcttccattttatattttcatccaatccatttattcacaatttgtatgtgactagtcaagctcatttgttttccatgaaataaatgcaattgattctgtgtgccagtcatggtttcttagacatttagtcattacttccacccacatatttcatgtttctctagaaaattggcagccatgtagaggcctaatgctcctttcaataccaacatttataatttgttacaagataattttattcatagggagactcacattaaagacatttctaagccactattatgtaccttgatgtagacagagtaaaatcggtctcacttttctataatgcagatatcactgtgatttataagtgacattaaaaatcaatgactatattaattcactaacaaggaaaggtgacagagtagaccccctcccagtgtttcttagcaatgtaactagctaaaaaacagaagcagcttaaaagttttaagatgagaaatatttttaatttaaacaaatgtataatatacttgtgcccttaattatacattcagaagccctctgattacagttgcccacaaacttaagtacttcattagataaatgtgctgttttccatgttaaaacatgttcggcagtatttttcaacttgacagttttacttactgtcttagaagcagtattaatgtactgcatcaccatttcttttttgatactgaagtccttttcccgcaatggtgcctttttatcttcatttaaattcatatcttcctggaaaacacaattaaaatgcctcattttagaatctaagtagagcagcaattctacatgcactacaaatggaaaaatcaataatttgtgactaaagcagcattaattgttttggaatgatttacgtgtagttctgcctgaaggaaggagagagaaaagaggtggagagggagagaagaaagtattctagatcattttaacaggtaaaacacttactaaaagaacttttaaaattcacagcaggcaaataaaattatattcacataactatagataattagacagttgcagatttctgccattcataaggtcacacaatttcaatatatttatttatttttacaacagctgcacctgaagctatcttccactgctttgaaagagctgctctgtgtgtcataaaaattaaaaggtaaataaaccaaccaattttcagattctgatagccacatcaaatatccagtactggttccagcaaaagacaaagcactttatagttttgtcttttccctactcttatcaaaaatgttaactaatttattgaatgttctaaattacataaaagttgtacttataaaaacagctaccacctaaaatcgaacatttctcaacagcaccaaccaaaataagggtttaagtaactaagatcttgctacaagcttaattttgactaaaaattcaagtcaggtatatatccacataaatatatgaattgctcttaattaagctcctgaagtaagaggctattctggcaaaggaaagggcgcctgaggtaagacagaaatggctaaaggagaagggcagctcaaatgaatttcctcgtgaacttagccctgagtcatttgtgatatgcaatgtaaaatatctgaatgtatataaacttcgtatctactcagaatggatccataaaattcaggactttggatcacctatggagcctagcaagttaaatttcttacagattttataagggtgctacattcatcaaacgctgtagtttatgcctttagctgactcaattcttggctaccaaacccttcgagcacttaaaagtcaaaattcccttcattttaccttgatagaaatatttaagatcttagaagctgttccatttgacactacgataaaaggtagtaattggcaatgtcacttttgctgctctagttagaaacacaaacatcctgttacgtgaataagtgtttgttttgtttcgtttttttctctaagctagtgagagaaggctcaataggccttaatatgacataggaagcattttggaaattttggaaacttctggaggcatgttagttgtcacaataattgaggtgatgctaccagcatttacagggggtagcatcacagtttgacctgtacagtaaaaactaccttgtgccccacagagagattcacacacctaaaaaagagagagagaaagaatcatccttaactaagcctagactcgaattcaatggaactgttgcaggacaggtgagccccaaatttggggctcatggcttcatcatagaaagaattcaaaggcaagatggtcgtgttacacagcaaccttttatcgaatggtgctgctccttgcagagcagggctaactcataggcagtgtgctcagagtcagcaatgtatgggctcttggcaattgtaattatactcacttaaactcacttagctatatgcaaattagggggtgggtcaatgtaaattaaggggtgggttatttagaattttctaggaaaggggtggtaacttctgggccattgccatggcatttgtaaattgtcatggcgctagtgagagtgtcttatgctaattaatgagggcagctagggattgcttttgtcccatttgccagttattgctgttttttgtgttttttttttttaatattttagtctgtctggaccagtttctgttttgatcagcagggttgtgactagaaaacatgttctgccagtctcctattccagaaatagatgtaaaatgtaaaattattacatattaaatactttgtattgcatagttttactttactgaattttccaagaatcaaactattctgtaaattatagttacactctgctttttttaagctttaccaacagttgtgcttcatttctgaaatgtaggtatcccagggaaatactgtctgtggtatctgaatccccaaaatagcacaactatatcaatctaccaatctacaatgccactgctgtactcacagaggtatgaagcagagattcaagagtatgaatttactataccttcttgagtagtcatggccaattgtttaaattgaaatacatattttattatatagtagagtaagacatattgattttcttaatttatgaacataggtaacattatccacaaagaatttcactggaagaaagtaatgagatagttaggggataattgttataaaacgtggggcaatctgagagcactggaaaattctgttttaaattattcactttatttttattttcaggctaatggccaaacattacccagtctctttagtaaattaaaatacttaatatacacagaataccaaaaaacagaaagccctttagttgtggctgaaattgaaataaaatttcaaggtgagtagtagaaagaattttttaaaaaggcctctgctttctttttggaaagacatcttcatgataacaccagttcatacaaaaaagtggttgtgattgttatttttgggggttggttaattttaggtgtgatggttaattttaggttagacttctggcttaaagtatacccacatagctggtaaagcattatctctaggtacgtctttcagaagagattggcacttgaatcattggactgtaagtcagtaaggacgatccgccctcagtatgggcaggcaccatctaatcagctgaaagcctggatagaacaaaaaggcagaagaaaggctaagtctccctctctcttctggagctgagacaaacttcttctgcccttggacatcagaactccaggttcttcaagctttgggccctgggacttcccccagtgacactctccctggagttctcaggccttaaagccacctcagcctccaactgagtttcaccaacaacttccctggttttgaaaacttggggccttaactgagccacgctgctgacttccctggttctccagcttgcagatagcatactgtaggacttcttgccctttataatcatgtgagccagttctcctaataaatcccctctcatatagacaggcaggcatcctattggttctgtttctctggagaactctgactagtagtgatacatctggaattaagggagaaacccaaaattctcccagctgcttcctctggtttatcccacctcttttgcctaaatatggcactcgccttcctgacaaaagtatgatgacagtcctagtataaaaaaccaaaaggaaacaaataatacttgctctaatttggatgttatcccatgcaaatctcatatttaaatttgatccccaatgttggaagtagggcctagtgggacgtgtctgggtcatgggtgcagctccctcatgaatagattaatgaccttcctggggtgggggcgattgagttcttgccctattaattcccatgagagcaggctgtttataagagtttggaacctccccaccaccttctcccttgcctcctctctcaccatgtgatctctgcacacaccagctttttcttgtctttcatcatgagtggaagctccctgaggccctcaccaaaagcagatgctggtcccatgcttcttgtacagcttgcagaactgacagccaaataaacctcttttttaaattattcagcctcaggtattcctttatggcaacataaaaatggactaagacaacaatacaaaagtttggaatcaactacataacaccctaaacttttgtgggatacccactaggcatgtaacttcatctaacaggtcatcctccatatttccaggaggaaatggcatttgaaagcgtaagaaaagctctgccctttaaaaaagaaaaaaaaaaagagagagagagagagaaataagggggcagtagagagaaaatatgcatgaaagcatgaggggtatggtattattagaatatattttgaatttctatttatggaaaacaaggctgaaagaagaaaactccatgaggcagtggcacttaacttctgggggtcacgaagtccttagaaaatttattgggagctttttttcctaaaaaatgcatatccatattttatgttgcaattccagaagggtgaagcatctcccaaggctatctaagaaactggacttggtgaaggtcagtgggggagaagtgagcaagttatcattttttatgtttcttagtttatatttcctcaaaattatcatgttgtatctccattatctaaggtcagtttcccttaaaagcagagcctgaaacagggattcaggtgcaggtggggctgctctcaggataagaaagtaaaggaggtaagacaaaagaggaaaaaagacatactaaaggtggcctctggtggattctcacttcaccctgagatgcaccacagtcaggatagcctggtagcagaaaccagcctcaacaacctcaagttagtcatcagctgcagaatcctagttctgatgagggcaaatctctggagaaaggggcatctataagctattagaagccaacactcatcacctggggcatgggtgcaccagcctggtaaaaaggagctgggagggggtactaaaagtacctactataccatctgaaaataatttacttgatattaaaataagacttctttcaaattgaaagaataaatatagaaacaaattgaacagaataaattgaacagaataaatatagaaacacatatagctgaccttaaaaaaaaaggcaatataaactattgtgtattaactcctccttccattcaaacacaggtcagtaaaacatgctgctttactgtgctaccacactacataggtacaaaatgacactgcagacacagattgtaaaacggctctaaaatggctgtttacctcaatatatcagtatgctgatatatgtacgtatctcattaaatatctattataggtaaaatactgaacaggaaatacaaagtaaacataaatacataaggctcagtgagtaatctgaatgaggttaaaatttccatggatatatgaaataaatctctaccctttaaatggaaaaatcttatcaactggctattgggctgaatatatcacactcaaaaacatcatttgccaagtcacctattcaaaattttaatctctctgaagagcatattattgtttttgatgttaaagttctattaaaaagttctattaatatgttagtaatatacattatgaattatctcattcatagtactccttaatatacagatgctcaacttacaatggggttatgtcccaaaaaagccattaaaaattgaaatgcagaaatgcatttaatacacctaacctactgcatgtcacagctcagcctagcctcccttaaacatcctcagaacacttacattggcctacagttggacaaaataatctaacacaaatgctattttataataacattttgaatacacagatgcacattttgtagacatggtgggatgcgaaaacacaaagcacaatatccaaaaaatgctggggacacagtacagtcagttgttcagcctaatgattgcatggctgacaggggagctgcagctctcagttgctgccccacgtcacaagagagtgtcaaactgcatatagctagcccaggaaaaagatcaaaattcaaagtacagtctctaccgaatgcatgttgctttcaccactgtaaagtcgaaaaatcgttaaatcgaaccactatatgttggggaccactctcggcttgccaggggaaaccgagttgcaacagcaaaaaaaatagtttccctttggccaattactttctaattaaaatctatatctaaacagaatcactgtgctgatctgactagcactaggaacagatttcagaagtacaatacttggaaagctttttttttcattcaatacgtgggaacacagctatgtcatccaaaaagactagaattaaaaagaccaaattaatgtggtaccagaaagtaagagaaggaaggaaggaaggaaggaaggaaggaaggaaggaaggaaggaaggaaggaaggaaggaaggaaagtcaaaaggacatgagccaaactgaaagagctgttaagtggccaaaactagaacaatttgaaaaataaaatgatagtattagattataacctaaaaagcaaaataaattgaggagatactttaagactgtgcagatatcctttttctccttaattatagaggggaaatactaactttacaagggaagaagctggcagatgccaccttaacaaagttgtccaggctaacaccacaaataataggacatattgatatttcaaacctccagctatgatataatgagaaggctgatcacctctgtggtatttatcccaaaatagatctcaatctaatcacaaggaaaaaaaaagtcaggcaaacccaaattgagagcaccctacaaaataactaaccataacttttcaaaagtatcaagctcataaaagataaggaactgtcattgactggaagagacatgacaaataaatgcaagatgtgatcctggattagatcctggaagaaaaaaaagacatgggtgggaaagctggcaaaatctgaagcaagtctgtagtttagttagcaatatcgtctcagtattcaattcttagttttaataattgtactaatgttatataagatgtaaacattagaggtagtttggtgaaaggtatacaagaattctctatactatttttgcaattcttctataagtctaaaattatttcaaaataaagagttattttaaaagactaaattgaaatattttaatagaactttttataaataacttggggtaaaaaaagaaaaacagaacatcattattaaaaaaaaaaagaagtttttttatatcccctaaataaaaagaagaggtttgtagaatattcggctatagtaaatacacactgaattgagggaggaaaggagactaaggaaaccacaatcaagacaaatccaagggtcctgagaggaagggttaagtaggtcagacacaggtaacagaattccattcaaaacacaaacttctccaactgtttacatttcctcctattttcattccaaacctgctctatgcactgaccttctcacccattctcccagaaccattttacaaagacctctagtactcctgtaatcttaaactatggtcaaattcttgagccaggcactgtgctaaacattcataagcattacttaattaatcctcagtaacttgaggtatgtcctctttattgaggagagagctgaggtttaggaaaattctgtaagttgaccatggttctttaacttagatttaaactctgttctatctcatctccctcattcttatttccatattatttatctatgttatcatctaaagtccgatttccttggggctagtaacatctgactgaacacttccactgccatcaacttgggttgattcctctgacactccacaccttgctatcacccacaatggccctaaagcaagcttgtccagattgcacccaggacggttctgaatgtggcccaacataaattcaaaccactttcttaaaccaccatgagatatttttgcgatttcttttttttttttttagctcatcagctatcaaaagtgttagtgtattttagttgcggtccaagacaagtcttcttccaatgtggcccagggaagccaaaagattgggcacccctgccctagagtgtccttggcttccttgccaatgcaagcttcacttccactgtcctcagctacagtcctaatgaccacacctggaccttttcattatctaaaacctgtccaccacaggcatcatcagaatctccataatccttatctctgacctcaatcttccatcttgccacttctcccactcccaaaccatctttttcttggccccagtaaaaacctccagtttcttgacccttccattttcttccaatgcaggccactgttgattcatcaattcttacaacatttatggcaaatcttactagtctctctcttttcacatttcatatggtacttatttcaaaccttagctattttcaggaactgtgaaactactacttctgcctatcaccctcagtaaataaatttcaattccctatatgaaaagaaagctataattccattttctgctgttttaccattttatttgcacactactatctttccctacccaaccaatgcatttatccaaagacattcctattcatttatgctcgagatcccttttcctcccacctcaagaaagggcattacacatcgattatcctcttctattttatttcactaaattctctcagttggttgagtatcaatatgtaagcaagttaatctttaatggattaaaattaaacaaaaaaacttccctcaactctggctctttatatgtaactcttttctccctcaccgataacatttaatagaaatatttctatacttgctgcctctttcaccgtgcatggaacataatggtcactttttaaatatttgctaaataaagaagatgtcagaaaagttctcaaatagaatttgctcatcctattttaggacaaacatgagatgcaggtaagcttctgggagatggaactgaagctggagatgatacagccccagactagaacactgagcaattgctgctcctaagaagattctcaagaatcttcagataacagttacgggaataagttccaactctggaggtagaaatcttcaggtcgtggcactgacacaaagatggccaagctaaaatccatcactttttcagagaacactagcagacccacactaaacctcagtgacctagaacagagtcaatataacgactgacccctgccaagtagtacctggttgaggaatgaatggggtcaaggtcccttccagactcacttcatcatctattccaaacttccaaacttgtgaccttgtgtggtgctgtgtccatccagaatgaaagcatacacctattctgtaacttgcacaaggacaccaaattagtcagcggcagcccttacctggaaaccaggtcaatcaagcaacttttaagatattcccaaagagtcttcctacaagttgcatggggccagaagttcccacacaccagcaaattgccagtttgctactgtttttagggaccctaactccctactagactgattttttaaaaatagtaccaaataaatatttttcacattttattagcaaaaccgaggtgggggggaaatatgtaacttagtacctgtgcacacacatgcaactcgttggagcactaaggcacaatcaagcagagaacagcaatgagagagtggacatttttccaactgaattacacacgttagactcaatattttcattcatggctgtggattttgcaagacagcatgctcattaaatttacatacatcaagttgagcgggacagttaacaccacagagagtcagattaaatttaaaatgattgactatttgcagaattaagtgaatatatacaagcagcaagttgctgaagatggtcaggtggaaggatattcaaccaaaaaggaaaaacactacagacaggcagagcatgactagcattacaaaatggatatgggaaatacagtattataatggaccaataagcataatattggaaaataaaaattagaagcactgcaatagcaaaaccaaacatttattcctattaagtcaacagcaatcatctaatttcaataacattatgttttgttttaggggttaaagccaacataattattcttggtagcagtctctgttttgccagcattatattattaaagccacaaattggttaagcatcttaagaggtccacaaagatcccctaattccctctcttgtgacagagctcaacatcatataagcacaattttatccagagttctgctaaaagtgtaattctgttcttaactacatttgaattcatctttgacatcacacaatatcaaacggtcaagcttttcattacactaaggtttttactaccatgaatggcttagtgccaaataaaaaaaaacagaagatttcatgacctcattcaaggtcattatacactgttgaacagggcagactaaatgaatcttatctagttctgcaatttaataaattttattgggtttagacataattagaaaactaaaagataaatactaccaagaacctggaacttagaattaactttattactacttttctatattcaagatgtctataaatacattgaagctataaaatagcttaaaacagctataaaatattttgcctatcagctttactatgtccttatataaacctttaaataatcatttttaacagaaatatgattatttaaaagttatattttttggttttaccaatagtggggttgaatttccactgtactatccagtagacactggattactcaattcccattaaaattaaaagaaagtcagatggctagctcattaatagaacagcagccaaagaatgacatttacccagagactgataatgaactcataaacactattttttggccaaatattctaactggagaatatgggaagagtgtaaactatcttaattgaaaaacaaatttcagtttatcctaatgcagtatcaaggcacacacacacacacacacacacacacacgatgagaaaaaaagaaatttaaatatcacttttctttcatatactgtaaattttagcagaacagacaagaagagagctgaatattcagaaagctgcacaactctaatttattctggaatgtaaccttgccagaattgttcaagtgtatgcataagcacctacaatcacaaacaactgctgtgtaatcctgcagataagaacactgccagtgattggccaggcgcggtggctcacgccagtaatcccagcactttgggaggccgaggcaggcggttcgttcacgaggtcaggagatcgagaccatcctggctaacacggtgaaaccccgtctctgctaaaaatacaaaaaaattagctgggagtggtggcgggcacctgtagtcccagctactcgggaggctgaggcaggagaacggcgtgaacccaggaggcagagcttgcagtgagctgagattgcgccactatactccatccagcctgggcgacaaagtgagacacgatctcaaaaaaaaaaaaaaaaaaaaaaaaaactgccagtgatgaaaaaggattttcattcatatatttgtttttcaacttttctaagtaaatgacaatttcttcatacatttacataaaggataaaatggtcatttgacttaagatacaacttttttcttaaggccaccttttctacagaagaaaatatgactgagaaaaggccttcacaggtatacacaaataattgcctgcacagctcctaactggcaaaacagcatgctgaaatattaccataacatttacccctttaaaattcctccctctaaccattttattggtgctacaaaatcccaccaggcaaaatccagtacacctaaatcatttattttctcatttatctggatctagaagaaacaactaaacactgacattatccccctgacaaacacaacccatgaatcaacttgataattgccttgaactactatactctctccctcttcctcttcattatttggattgcttttaaaccacctttccctgaatttttcaatttctacccaatggagagggaaaagagtgacaagtaataaatcagaacaaagcattcccacagaacctctctcattttatctagtcaagccttaatacacttttttagattgtaagaaatagaaaatgttcacgatataggaaagtagatttgtaaagaatactaatacttgaaataagctgctggtaggaatctatagcagtcaataaacacttaagagaattaacacaaaggggtctttgttggtttttcttttcattcagactcttggttgacccttaagatattccttgcacactcaacacaaaattcatttatttgaccaaagtaatagctatgcataaatctttaacaccaagaattaaagagaataaagaaagaaaaattgtcattagtatgtaccctaagagtggcaatatggaataagcttagcaagatgaaccctccccacctctataccaaaaatatcaaaagaacatggtcacatctgatttttatcggttcacctgagcccttcttttctcctctggaaaaacagctcttagatattaaggtttattatacagttgtggtgactaagacaacagacgtaaatgcagaactagacaaacgaactgatggacaaaaatcaaacctcagaaacaaacccacatgtgcacaaacttgatctataacattagagatattacaaatcataaaaaagaatgaactattcaaataaatgctgctggaaaaactatgtggaaaaaaattggatccacatctcacatcaggcatagagatatatatttctaataattttaaatgaaaatataggagaatagatttatgatgtcaggatagatttcttcaataatatacaaaaaggacaaaccataaaaagtttgataaatctgaccacaattttacatttttgtacttcagctcccctttcccgctaacaaaagtaaaaagacaagactcggtctaggacaagatatttgcaacacatataaactgaacacatgagtattattctggctatatgggaaattctacaaatcaatatgaaaaagacggaaatctcaaacaacaaaatgggcaaaaatataaacagaaaattcacagaagagtaaagcaaagggccaataagcatgtgaaaagatgttcggacacatttataatcagaaaaatataaatcctttagtatgagatatgctgtttacatttgtttacttgcaaaacttaaaaagtctaatactaatgcaaacagggatgttctacaaattaaccagcctgcaatcttcaaaactttcaaattcataaaatacaaggaaacatacgaactattccagactgaagaagattttaaaaacataactgaatgcaacatatgattctgaactagattcttttgctataaagaggatattggtactattggtaaaactttaatagtgtgtgaggtagaaattgatcagtgttaactttctgattttggtggctatattgtggtcatatagaaggaagtccttacttgtggaaaacatacactgaagtattacaggattatggggcattgaatcagcaatttaccatcaaatatctcagaagaaaaaaggttttgttccgtataactgtattcttatacagacagaaaaaaaaaaggaaagtttcttcagtgtatgggagcaaaactattggattcagggtactgttaacctcagggaaaaaaagaagataaaagcgggaattagaagaattacacaagggatttcacttatatccgtggtggtattttttatattatgttctatactttttgtatgcctgaaatactgtataatttaaaaaaaacactgcaggacaaaattagattccactctatgttatacacagaaaattgtttcaaagtcaaatattaatgcctttggtattatctaaaccaggtttcccacactgaaaagccaatgtatgtattaaatagtaggtcatctaagttcttactaccaggacatacttcaaacatacgcttaagagatgacgatggcattttataaatgtgctttctcctacattacaaaaaagcctgataaacatcttcccagtaaaagaatagaacatcactattcatacttaagtacttcgtgcaattttatcaggtcattttttctacacttacaacaattctagacaggaagtccagaatttaaataatttttgtcagaatgattttggtatcattggaactcatttaatgcctgttaatgatagcattctgatagatgagctttcttgcatagctttcattctctcaaccgatagtgaaaataagaaaaggtatgaatgcatgaaaaaagctatcttccattcattattttaatgtttttgtgttattgggctgactagcaattaaagctaatctccatctaagtatagtgtctaaggtgaagagaaatatagtatcctagaaatcttaagttaggaagctgcacttaacagacatttgtttggaatgataaaccaatggatgatactgcatggatataatctaatgggaagacagatatctaaaaagtgaaaagtaaaaaaaaagaatgaatttcacaatagactcataagcagttttgagaggcaggtttaaggaatccttaactcagcacatgtgaagataattaaagaaaactaatgtttaaactaagatttaaagtatgtataaggccaggcacggtggctcacatctgtaatcccagcactttgggaggctgaagcgggtggatcacttgaggtcaggaattcgagaccagcctggccaacatggtgaaaccacatctctaccaaaaatacaaaaattagctggcatggtggtatgtgcctgtagtccctgctactcaggaggctgaagcagggattgcttgaacccgggagacagaagttgcaataagccaagatcatgccactgcactccagcctgggtgacacagcaagactccgtctcgaaaaaaaaataaaaattaaaaaatgaagtataagaagtctctaacagaggcatggagggagataaatggcagagaacactgcagtatcctagataagaggtcatgaaagcttgaactaaagcaggggggaaataaacttaagagctaatgaagatagagaagtaaatggatgtgactgatgccttaatgagatcaactatgactcccaagtatgacttcagtggggacttctgagataagaaattaagagtgaagcagaaattttggtgagtgggtgtgtgtgttggggggaggtgtgtgtgtatttaggaaatatgatgagttcactttctgatgtgttgaggttcagcatcttttagagagctggattataactgctcttctgtagaagacataccaaggtgtcacaatataaaagatattctccatgaaagggctcaagtctcccaaaaggagtacgcagaaaactcaagtgtataaagataagactgacaggcagaggcaacactgagaggaagtaaaagaacacatagaaggatatggagagtaaactggaaaaaactggccagagagaaggaaaattaggaaaagtgaagtgtgtgtcacagagacacacacttctttcacacggtgtgtgactgccacagaaccagtcaagccgaccaggatttctcacttacagaactataataaatgtgtgttgctttaaatcacaaagtccgtggtaatttgttacggcagcaataggaaactaatacaacactctaggaaaccaatagataccttaggccagcaagtgctcattccttccctcccccgaccccaatctagtcttggaagagacaaattcagtccagagaatagggaagaatggaaaagcaagatggaggaaaagaggccaaccacatccccaacaactgcccctactggagactagaaatggaacaagcttgaacaagggaaaaggagcagctttctttgggtgaaaattaatttatattaagctagggtttgtattatctgaaaccaacaggaaatctctggaacctacctgggacttttaaccaggatcagaagaaaaataagctcagagggctgatttaaaggtgcaacagctggaataaactagccacttccaacttacacctatcatgttcaccttgttcaaaaaacactacttacaggtatctaagagttcaggagtaatcactgaaattgacttcagaaacgtaagttgtaaatgtagtgatgaacacaactatttcacgtatctaatagtcatacagaaaccaatatgggctttcagctagaatttcagctttcaccaaaagacaaacggggggaaaagtctttaagtataactaaaaattcaacaccacttttaagaatgcacacagaaactagactattacccagagaccaagtaaatcaatttcccaagtgaaatgagtatgaatgttgaagttattacactgtacttcacattcattaagtaatcaagtcagcacagtctttcaaaggactgtcttgaggagggaaaagaggtgttcttcaaaacaaagttgttacttcatgtaaaaattactaaatacctttgataatgataaataagaacaatcattgtaaaaattgcacaatgccaaagcaaagaacctagatgcaaactttaaatagtataaagcctctgtaggtacaaatgccaaaaggttaccatggctgattattcaatgttgctttctcaagagaattcttattaataaaaatgtaacagatacgtacaagccaaaaatcaagccagtttaaatctagcattctccacagacatagaaatagctctaaatttgtcaaaaatatggtaccctgagaagtttgaaaaatatcctaatccacatttaaagaaggcaacaacacccttcaaaagcctttcagcttcagaatcaatagcagtttttccctacagagtactgtagtatactcaaggaatcagtaagggaaagaaagaatctgtttcttattttttaaaaagggcttagttgtaattgtctcatcccttagcaaattggacagccctgagaaggcaacaatttcattttatttctgctgagttactccagtgagggtttgatcaccaaaatctaatgccaataggtagacctgcttaagggtgaaaaagtgatctggcccagttattttaaaagtattctgtaaatatttcaaaaatgctgatattcatctgacctctaaataatattaaaatatatagtattagccccctcccagctacgagtaacagaaaactaacataaactatattcagtactttctaggtagttgtacttttaacttgtggaaataaaatgtggcctccataaatgtttaacatcaatgggctacttagtccacttactcagatggcaccctcaattatgatgaaattttttaacttagtagccacaagtgaaccataaaagtgtcatcctgaaatctcatggatggataacctaggtgagtggttcgatatatagtgcacggatgggagaaaagtgcactttacgatcttgagtcctcaaagatagtactgaagagagttaccttcatataggcctcattaacagaggcaaaggctaaccagaaaaaggttaggcatccagaaaaagacgtagaaagtgagttcaagtctccacagatctaagtgttgcaaaaagaacctgtttatcctaaaaactaagaaaagaataaaacaagttaggtctaagatccagcccataacaatgcaaacagtagagcacagtgactgtcattttaacatggactggactcagaccacttagatcaggggtccccaaccccgttagcaactgggccacacagcaggagatgagtggcaggccagccagcattaccagctgagctccgcctcttgtcagatcagcagtggcattacattctcaaaggagcacaaactccatggtgaactgtgcacgcttcttatgagcatctaactaatgcctgatgatgtgaggtggaacagtttcattccaaaatcatctccaccaccccccaaacgctcatggaaaaattgtcttccataaaatcagtccctggtgccaaaaaggttggggaccgctgacttaaatatctactcaagacaaaaatataccgttcgatactttggagtatttgttttcacatactctttacaaaaccaaaacctggtatgttgtttttcttcagatttcatatttttgtaatccaaaaactctttgtggctgaagtgctatcttaagtgacatcagaaattagcctatggagtatgactaccaaaaatgcttagagttccattaacatgagcaaaagctaaggctttttcctcaaacatttcctaaagaatcaaaattcttaccatcattttttcaaaaagttctaagagttcattctctgacagtggctttggaaagttctccatcatctctaaaggtgctgctgagcaatcactgcttgcaaatgcagtcttcaggttgggaagtggaggtctctctttcttgctccctggaattcttatgctggcaaatttgtccagctacaaagaaagacagaatgacacacgtgtaagtatttcctttcccaacatttatctcatctcaaaaatgagaaaaacaaagagggccaatcgtgttatcattgtgatttcatcaagaggcattcagcattggaatatttaaaattaataataataaagagtggtgaaaatttttcagcaaccattctatctaaagattgaagagagctcagacaacattgaaagattccttctaatcttaaaaccacacatagatttgagcttctaatgacaggtgacctttgctttatatattagcaaattaagcagtttagaaagattacttagataatttagtgttggtcccaaactagtactcactgtcccatctcccaccccctcctggcccctctgcctattgccctttccataatgcatcctgtctctcggagtgggggtgggaggggaacatgatttaggaatttttaggaattgaattctacttatatcttcatagcttagtggcctgataaactatttatctttgttcaggctggtctgtatgtgaacttcttgaatatctacagggcaaaatggttaaggccttaagaaataaacctagatttttgttgcaatgaaatttcttctacaactagataatcaaatagcttgctgacattcaaaaaagcatagatattagtttacaaagctaattattcatttattcaaaattgtttgaatttcacaagttatattgctcacaaagaacccagactcatacatttcatgactaatacaatgtttcaacaatcaaaaatgcaaaaagtcttaagctgaaccaggcatcaagaatagaagtatactcaaacagcacagtgattccatgagtttttttttatcattgttgtatacatttttaagctactgttctcaccacgtatactgtatataaacctgtactattcattatggtagccactagctatgtatgattattaaattaaattgaatgatattaaaaattcagttccttcattggactagcctacatttcaagtgctcaagagccacatgtggccagcatactaatacatatagaacatttccatcattgcaaaaagttttaatggacagagctggtatagccattaaaaacgtctgatacctcaaaggttcaattcaaaaggacaattaagtcacagtattgtttattcaattcactaaagaaataggatttcttcaaataatgagatgtaaagataagtattatctttcaaaataggtttctaaatttactatgaagataatgtctaggaaaaatactatgtactgcactcacccatggtccacctaacatcacttaaacattaaagtactaagaatacgacagctttctgtaggatttagaaagttgtcataaaacaccactgctctcattctaaccaccaaaacaaaccagaaaacgtataaagttatacttgctgttgtcgtcaacccaacagaaaactgaagacccaaagaaatctacaagaatcaaataccagaaaatgacaagctgctcttatccctgacaaacagttgaggaagaagaataagttaaacaagggtaaagaaaagccagccaaatatttaaggaaatattgatagctgcatgggtgctggcattagaatttcaaggagccccacatgaagccccagccatttggcaagtctacacccacctaccaactctttccctagtcttcaccaactgaatgcggtagtaagccaatggctcggagcagaacaggaaagctgtatgaatactccgtgaggcatatgcaaacaactgccctccaaaggccatagactaggcaaaagactggagagaaatccccatgacacattctggactttgaaagagcatgtcataatgccatctaaaggctggggcagggtacctggtcaaagagatttcctgaagaaacagccagaagtagaactgaaaacagaaagagaactctacattaaccctaaaatgggcattttttttttcctgaaacgatataatgaagagtggacattacacatgagatgaataatttcagcagcaaagtcacagattaagaaaaaaaaaaacacggatgaattagaaataaagaatagatcggaaatgaagattttcttagatgagcttaacagtaacctggacatagctgaggaagaatcagtgaacctaaacccagatcaatagaaagttccaaactcaaacacaaacaaaataatgagatagaaaaaaaattgagtatgatctgtgatacacatcaaatgttgtaacacaagtgtaactggggtccagaagcagaagagagagtggaaatggtacagaagaaatatttcagaagataatgactaagaattttccaaaattgattacatatatataactcaattcacagatccaagaagctcagcaaaacccaaaaagaatacaaaagacacacacacacacacacacacacacacacaaacacacacacacacctacctacccctaagcacttcatggtcaaactgctgaaagttaaaaataaacagcaaaccataaaactacagccagagaaataaaaatacattatatacacgagaaaaaaatgatatgacagctaatttctcaccagaaacaatggtggcaaaagacaatggaatggcatctttaaagtgctgaaagaaaggtagggttgactcttgaacaacacagggattagggcagtcaaagtccacatataaattttgactccccagaaacttaactacttatagcctcctgttaatgggaaaccttaccaataacataaacagtcaattaatacattgctgtatgttaaatgtatttactgtattcttacaataagttagagaaaagaaaatcttattaaaatcataagaaagaaaaaatacatttacaatactgtactatatttatcaatactgtaagtttacatcatataacaagatgaattgtctgctgaaatggtgaccaacacagctacagacctcaatctatacaattcacgtatcaagcaattcacctttttcttgtaatgtcatgagttttctctgattcttgggatcacttcaagcatcactagtggcactttgtatgggtcccatggtgttactcagggtttacggtattgcactaaacacgatgaaaaatactcaagaactgcaagagatcagtttttactgaaatacgcaatttactggagagattaactgctcaagtggagatgattagtgtcaggtgacattttaagtagatactcaacacacctgagctcaccggaatagcaaccagaggtgactacaacattaatagagtaatatagtgtgcggtacagttaattttataaagttatagtttaatactgcatctttacatttgttcacatttctcttgactgcaaacggcaccatctttagttcatgtttgtatgaactaaagtcaataaattttgattaattttaactttttttataatagatttgtaaatgttttatggtattaagtgagaaaacagactattatttaaatatattcaagatatatataactttttcttttttcgagatttctaaccagtttgtctgcaagttttttcaaattattgcaaatctacaaaaatctccaatatatttctttgaaaaaaacctgtgtgtaaggggatctgggcagttcaaatcaatgttgttccaggatcagctgtactgttatcctgggattctatatacagtgaaactacccttcataagtagaagcaaaagaaacacactttcagacaaaaactgagataatctgtctccagcagacctgtactacaaaaagtataaaagaattttttcaggctgtagggaagtgatacatatataactttttcttaacttgttctgggatgaaatcctagatctacaaaaagaaatgaagagcaatcaacagttgtctattagatgttggtgatacaaagataaatgagctataagacttaccttaaataattatcaagtggaagagacaagcacataggtaattatatagctacacagaaaatgtaggaggtatgtgaaatgtattataatagcaaaaaagagtggcatataactcaccaccataagcgtttcctactctggaataactcagaaacataaaactgtctccacatgaatatatgtccagaagttactatccctatgtacatttgtaccctcattactgatgtttgtttaaaacaaaaacaaaaactgagagaaaccaaaaaaactgttttaggaaatgggactggttacctatctcccaagtcactacttcattgccatcatttctgtacggataatatcaattcctaagcacagaaactattctggttctttacatacacacacatccaaaaaaaaaacccagtgtaacttaattaatatgccaaacttataatgaagtgaaattaagcaaaacttcattaatgcaacatcaatattataaatgtaaacatgtcaataaatgggaataataagcttaagcacttcacaagctaatttgtaaatgcataacctaatggttctaacagtaatagaagacataaaatcttaattttcaccaaaaaccaaaactttttttaaaaagaatctctaaagtcataaaaattaacaatatttttactaatatttactgagccttttctatatgtcaagcaccaggctaagagcttgaaatgcagcatcaggttgaatacgttggtttaatccttaaagtgaggaaactgtatgtctaaaaaataaaagaacaagctccaaaacacttttgtacctaacgatttcatagtattgagctcaaaaataggacaaaggaaaaaaatcagccattaatgctttcaggagtaaaactagtaaaactgtacttgtatcaataacataatttgtaaaagtaataacgttaataataaaatataattatcacacctaccccatatgcttagcacctaaaactctggggaaaagataaattttacccaaatggaaaaataaatttgtacattaccactagtatagacggatgaaggcaagataggaaaaattagcattcccctcttctagcttataaatccacaatggtcaaaatagtaatatgagatacaaaaggatcaatcagtatttcatattttcaatataatgcttttatttcttttcccagataagaaagaataaaagaaaaaaataaggaaagaaccataaaagaaaaataagcacaatccttcctcctatactggaatagcaactcgaatctaatgaatacctgaggctaaaagtaaaagcattccgtgccctattgagcactccaggtagattctacaaaatctgggcactataacaaagctaggcacaaagtgagctttactatcaaatcattttacatgttataaaagaagtttcattttttaaaagagaggttactatgattccattcacacatggaaaaatcactcctaatctatctttgatgaaattgcacacacgatttgcttaaaccaaggtacaatagaacacttgagcaaactttaaaaatactttttacataaaaatatgacaggaatccccctaatattgaccataagttggttatcttgtatttggcaatttggctgggggttgtttatgtgtgtgtattacaatttgtgcactttctatttcatgtaaaatttccataattttatatgaaattctcctcttaaagttgagcaagaaacacaacccagagaggtgaagtatacaaacaatttgcctttgttgaagaattagttaaacatatgcaagactgagaagattctgttataatgccatttggagatggtacaccacacttcattaatatggctttgactgtgtctggggtacactaagttttataaattaatatcacgtatcttcaggggaagctaaatgagcaccctactgagtattatctcatactgagtaattacactaataatcagtaatgacagtttaaataaaattaattaaacaaaaaaaggttcaaaaaaaactatctgaatttttagctatagtatatcactgtaaaagtgaaaactcagtgtttaaggttttcagtattacaacattttaaacaccaaaaggcaagtgattctttaatttaaaatgaaaggaaaatataattagtcatcttacaatttcacaagtatgaaaaactacatatgatcataaacatacttcattagaacccagaagggagtagaaattttcacgaaatccaggagaattattaagcaaacaaaaattccttctcattatagaatcaattctatccaaatacatacctgaaatacagaataaaatctactgcttgaaattctctattttcaggcaatcttacacgacgcttaagagggggtaaaaacctaacagctaacatagcttggctctttagttaactttattactaatctgggaactttgtgattaaaaacaagcaaggctctggagtcttgacttcacaatcctgtccagccacttgcttagtgtgttaccacaactaagctacttaaaccttccatgatggtacccatcacagagaagtgttaacaggaaataaaagtactattcactctcatctttggatttaaaaggctgaaatgccttccctgaccactttatctaaagtagcacgtgtacccaccccttatccgtcacagcacacagtacagtctcttcctatgtcctttcacatgacttacgaaaatctgtaattatctcatttattttgtaattgttaactctgtctctttccaactaaaatgtaagtgccatgctagacaaaccatcaactgttttaatcactgtggcagcccgtctctaagatggccccagtgatcctgatttatgtaaccaacagatattttggaaattatgaagtgcaattttcaagactagatcataaaagattttacagcttttgttttgctccttcttgggagtatgccagctgccagatcatgagaacactcaagaactcctaaggggaggcaaagaacatgacaaagaattgagggcttccactaaaagataaacaggtttcttgccaacagccatgtgagtgagccatcttgaaagtcctggtcaagccttcacatgactgtagctccagccaacatttttaccgcaaactcaaggcagaacccaacccagaaccacccagctaagcaactaccaaattcctgacacacagaagtggtatgaaatgataaatcttggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggtaggagaatggcgtgaacccgggaggcggagcttgcagtgagccgagatcccgccactgcactccagcctgggcgacagagcgagactccgtctcaaaaaaaaaaaaaaaaaaaaaaaaagaaatgataaatctttgctattttaagtcactaagttttggggcaactcgttatataccaacagataacgattatagtcatgttgtgtatgcagcctatagcacagtacctgatagttagcagtcagtcaagtaatacttgttgaaggtatgaatgaatgagcaattactagatgataaaatatataaaacatagttaccatccctacagatgcttaccatttgagagaaaaatatacaataaaggatcataatttaaggtagaatattgtaaatgcccccaagaaaataagccaagtgaactagcaacaggaatgaatgattaattctagagtggggaaaagtaccttgagaggggctttggaatgtaagtacaacagggaacttgtgatgctgatatgaaaattatagaacatgttaactgctaagcagtatgtctgcctgttccatggtctttacatttaagcactagtgacatcactggttttacaaagatgtatcactgtggagagaaaaaccaaccattcaatctttcaggtatgataagctgaggccagttttaggccatagacttaaccacccaggaacaattcctaccatccgatcaactgcattctgacttcgatattcctcaatgttacaaatgggcttcttcacctcttaatttgtattttactggaatttataagaagttctttagccagaggcttctttgaaaagacgaaaacttactgttccctccctaccaaaaaatacttgattatctacttataatattttgtccacatttaggtttcacatagtattttaatattattaaatgaaaaacaaatttatgctcttaaaatttcttcaattgcttgaaaataagttacaacatgcaatacgtgttctaaagccagctgtcatgccatggagcagtgtttggagatgcctgcacagggaagaaccgaggcctccccgcaccaattagcacccacttgccagtcatgagtgagccactttggaaatagatactccagccccatcaaggctgcagatgattataatctcatgaaagacctcaaaacagaaccatactgtaagctgtttccaaatttttgatgcaagaaactgaaatatcaagtgtttattattgtttgaagccaccaagttttgagaaatgttatatagcaatagataattacagagctcctcatagaatacttttaaatgcctaaaatatatacgaactaaagtaaaatgaggttataaaattattaaattttaatatatcaataaatgttcttcactattgcattaaataacaaaggtaatgacaagtctaatttcaacatattgtcaaatgtaaaccatattttgaaatgtcttcagtaactactgtgctttgaaaatatctgatttctgttggtgataaagtcgcaggccaaatactactgtgggtttttctggcatgctgataggttttttttttcctatatgcataactgaaagaaatactaaatttcatttacagattaaagaaaataaagatttaattttttcttcaaggacaccacgaattccaccaagaccccttggtggtccatggaccacaagctaagaacacctggtaggtgggtacagaacgatagcagaaattgtggtggaaaaggagaaagtaactcaagttccaatgccttcagtgaatcagtgggagggactagaagacctacagttgagaccaccaacaaggaggaaccaacaggttgtatactctgatggtttatgcttcaaagagagctggaagcttttgaagtaagaagccaccaggaaaataaagccatcaaagaacatccaggtttcaactacagcaaggaggaaagagaacattcaaagaagacgacagacttcgagttccaaagggcaaagtaggagggtttgggaagcctggaggacttgatagatatcagattagaagaatgaatggacctgaatagtgagagaagcaaaggggtgattactgatgatatgaattgattatgactcagctctgccgaaaggtgatttgaattgtgataactgtaatgaaaattaataaagacataaaccaaagcatgtggactacacctcctttattcatcttctctctgtctctactgtcgctagctcaggccacttctaacctgcctcctagccttctaacctgcctccatctcttcactgccctctccccctaccatgctatagcaattctctaccccaacatcattcaaccacctgaaaatgcaaatccagtcatgcccctcactcctgtggttaaactctttcaatagcccctcattactcaaaggatgacattcttggctcaaaggttcatcttgatctgaacatatttcctctctagacaatcttttcaccactccaccaccttacactgtatgatctagagataatgaacaacctagaatctcctaaacatgtacaggttgttccttgtgcctaaaacctacccacacctcataccccatccccttacctggctaatttcaactcaatcttcagctcccaacttaaactacagctcatgtaagagcccattttgattcctcaagactgagttagatgctcaaagacttagtgcttgcatcatataatatgtatacaattctttaaatgcctgtgaactaggctttaagtccttgagaacagatactgttattttattcactaaaccccctctgaacttaccacagttctaaacatgtagtggatgttatattaatatttgttaagtgaataaattaataattagcttcctatcttccaggcctggaacaccctagccattgcttcttgccatgctaaatttttctcaacaatattttaaataaaaaataattaacacagcatatgaagggagaatgccaggtgttatgccttttatatattcaataggaaaacccagactcttcctaacactgataatttagagtaggcccctacactaaaaacaaggataacttatgttatttaatatcatgatataaggtaataagaaaaatatccattcaaaaaggagcacacatatcattgaaaaaaaatttaacattcaagaaaccccaaagttctatctacccatctactcaaagtacaattctaattgcatatatttaaatattaataatatatacttgagaagtaatataaattagccctgtatatattacattttattttaaaaagcatagacctatattacccataaacaaaaagtcatgtgaagacatcaataatcgctttctacttgccaacctgacatgcttccactacgaatccatttcattggtatgccagaagtaaaattaataaggagtaaaaattacaccaactcctgccagcccagattccaacctgtccttcaaaactcagctgaaaagtcaccttcacatgaagtcttctaagatcaagtgaccttccagcccctatcatatcacactaaaactactgattgtctatacatccatttctctactgcacccagacgacagagaccttctttttccatatttgtatttctaaaagagtactaggcactcaacaaattattaatgaatgagtggacaaaacaatgaatatacaagtctgtacaccctactacatattagtatattcaactctgagagctcttgatcttattcccaagtttgtgctgatttgaggaggagctctctaaactatcctataaatatttaaagattctaagatagtacttaagtattactactgaaaatttaagtacaggaagtcctaattaactcattaatgggctaagaaaggcccacctgactaaatgaacagtttaagttatttaaaacagaacttgtttggatgtattttacattcagtcgccccaatccatgctggtatttctactttacacagaagagtataatatgaatatatagttttactgaaaaactgtggttgggcagatggtacatcacactttttatcactcattgttattaacttaccaaggaaaatataaaaagttaatgaaaatagaaagtaaattatagtacagagagccttatatcctactagaataataagataaaactatcttaaataattctaggttgagcctttatttttaaaagctactgacttatgttctattacttgactttaaagttaggcacaaattcaggtaattaaagtcattttcctttctttcataaatatgatgtataatttagcatatatcccacaagacacatcacatctaggtaggtacaggtaaacaaagctcagtcctattaggccgcattcatctttgagtgaagtctcacagaaatcacatcggaatgtactagagttgtctggtaacagttataccgaggaagaaggcccagagaacagttaggaggtgagagaagagtgaggtgaaagcttccactcactcactagaacctacatccacagcaggtgatttctgcagtggctctatgaccccattaccccgggaactttgaggagaacaaggaaagcctgtatctatatctgggcgcaggcagcagttgttctgagatatgtgaagtgctttctatacagagaaatttttccatgtcctttgtaattaaaagaatctcatatcctttaacagatgacctctcagtccaacacctcactattttttggggtggatttttttcagttttgtttacttgagatattcaaaatagttcatttctcatcttagaaaacatcttagatatagtatgtctttataattataatgattttctccggattaaggtcaatggctatgatacaatttctcttttccaattagaagtctcatatcgatggcatcaagggaaaagcggacaatattaagatacggtcttggtaacatggagaaaccccatcgctacaaaaaaatacaaaaattagccaagcaaggtggtgtatgtctgtagtcccagctacttgggggtctgagctggagcccaggaggttggggctacagtgagctgtgtttgcaccactgccctgggtgacaaagcgagaccctgtctcaaaaaaaaaaaggggaaagaatgagatatacttctagattttacatttggtgctctcagcggagaaaaggatagtacttaaatggcattataatgcttttgataaagatcatgttacttggagccaatctgccagagttttcctggctgccctctatgactctgaataagttacttaagctctctcttcccccagtttccccatctttaaagatgggaacagtaacagtgcttactcagaggtttggtgttacaattaaatgtgtttatatagtaaacatttggaacactctttagcacatagctaacaattacatagtccttactgttacttaacacaccgctcttctaattagcaaccacaattccctagttatgttgttttgttttgtttttttaagacaaggtttccctctgtcactcagactgcagtacagtggcacaatcatggctcactgtagcctcaaactccagggttcaagtgattctcctgcctcagtctcccaagtagctaggactaggactacaggttcacatctgcataccatcacacccagctaattttttttttttttttttttttttttggtagagacagggtctccctatcttgcccaggctaatctcgaagttctgggctcatgcagtcctcccacttcagcctcccaaacaaagtgccgtgattacagacatgagccactacactcagccccctaattatgtttttatactccctaagtaaattctccagcatcttatatctttgtattccctagaaggtttctgcacgctaatgagagatgcattatcaagttagagaggcagggtcctgtcatgaaggccttatctgccatgttagacttgacctatataaaacagttgcaattaagcagtttcaaacagcataaaacattatcagataggcaatgtagatagatcactctgatagctgtgtgggaaggtggcattttgggtagcaataggaagctgccagagtccagagaagaaaaaatgagaagactaggactgatagaagaaacgagagaagaagagattcaagaaataatcagaaagaaacattggaaaggtgaagctactttctaagagaatataaggaataaaacaagtttatgaggaaagtaaagggtttaacttagagcacacagagcttctagaatagatgagacatccattgaggttattcagtaggccaatgaattatttctcaattggaggaaaaggtcctaaacagagatatacatggttagttgaaaacttcagaggtgattacccaagtaaaacactacataccgagggaaagaatagtagaatcaggaaaaacaactgagaaaaaacaataatttaaggcaaaaaggaaaaattatgcaaccagatagataatgaaaagtcaaaggggtatgaaattgagaaaatttgatgtcacagaagtcaagaaatctttgttctccaaagaagcagcatatgattatatcaagtagagtaggtaaatccaataaatttccaagaactaaaaactaataaaaattatttgtgattttaaaacgtcatttattaaagataaagaagtcacaacaatcttatatatgcactttactgcaaagcttcaaaatacgtgaagcaaaaaccaatcgaacgggaaaaataaaatctaaaatcacagtgggagacttcgatacttctctcaataattgttagaacacacagaaaattaacaagaatacagaagatgtgaacagcactaccaaccattcagaatatacacgaatactgaccaagatagaccatgttctgggacataaagtaagacttaaaaaatcagaaaggacagaattcatgcaaactacaggtctctgaccacgagggaactaaattacaaatcagacacagtcaaatatcaggaaaacccctaaatatttggaagttaaataacatataccaaaataacccatgggtcaaagaaaataagaaatttaaaaatattcaattcaataaaattttgtgggatgcagctaaagcagatgtcagaggaaaatttatagcataaaaaatctaacatgttagcaaacaaaggtattaaatcaatgacttagagttctaccttaagaaatcagagaaaaaaataataaaacaaaagaaagtaaataataaaggtaaaacaaacaaaaacaaaagaactataaagaaaattagtgaaaacaaaagctagtttttcaaaagatcaataaaactggcaaacctctagccagactagtcacagagaaaaacacagaaaacacaaattatcaatatgaggattgcaaagggggtaattaatacagatcctgcattaaagggataagaaaatatcacaaacaactttatacccataaattcaacaacatagataaaatttaaaatataggtaaaaatttagatttaacaatataggtaaaatgtatgtccttgaaagacataaactaccaaggctcacttaggaaaaaatagattacttgaatagtcctatatctagtaacagacatttaaacaagaaaatgttaaataagcacataaaaaaaagttcaacattagtaattgtgggaaacaatttgtcagtttcttatcaagttaaagacacacttactatatgactcccacaaaaaacaaaaacatatacacaaaaaaaaacaatgctgtactcaaatgctcatagcaactgtactaataatagccgaaaactggaaacaacccaaactgctgaagttaaaccaattgtagtattaccaaacaatgagccagacacaaaggcaacacactttgtgactccatttatatgaaattctaaaaactgaactatagttcagaatgctgataagtgtttgtcaaaagccaggatgggagaagagaattgactgtaagcgggtacagagggaaccttttggggtgatggaaatatttcatatcacgactagtgcactcattattgtatatatttctcaaaattcatcagattatactcaatactggtacaatataatgcacgtaaattatattgtaagtaaatcatacctcaactttttttttaacttttaggttcagaggtacatgtgcaggtttgttatatagataaactcatgtcacataggtttgttgtacagattatttcagccaggtactggtcctagtactagtacttaatagatattttttctgatattctccctcctcccacccatcaccctcaagtatgccccagtgtctgtttttcccctctttgtgtccatgtgttctcatcatttagctcccacttacaagtgagaacatgcagtatttggttttctgttcctgtgttagtttgctaaggataatggcctccagctccatccatgttcctgcaaaggacatgatcttgttcttttttatggctgcatagtattgcatggtgtattagtaccatactttctttatccaatctgccattgatgggcatttagattgattccatgtctttgctattgtaaatagtgctgcaatgaccatacgtgtacatgtgtctttatggtagaaaattttatattcctttgggtatatacccagcaatgagattgctggatcatacctcattttttgaaagtgtgtattactaaacatagcactaaattataaatgcacggtttaccaagcatcttacttaatttgtcccttaaactatctctataccaaggctcaaaagctacataactaacacaaagtcacacagctagtaaatggcagaggtggcattctaacctggctttcctacatgcaactacatataataaagaatagacactaatgcaaagacctcatgacttcctctagtttctgtgcaggccaatgtttggttttctagctatagctgttaaccatttgtgggtcatgaaatcaatttagtggattcaattaccttttttttttttttaaggaatggagaggagtgaagaaaattagaaaggaatggaaataaaaagatcagaattcattttgcttagaaatgttaaatactggtttttaaacttttgtttcaactgagaagcagagagtttaggagtttatgcatgccaggctacaaaataaaatatatttcttaatgcagtatctagtcaaaaagatttgaaaaccattgctgcaggccaaacagtaaagcaggctgcagtcagatgaacaaagagatgaggatcatagaagtactatactgtagacaaatggttatgaaggacaggagagaaaacagcaagtcaaaaacaactcctatactccaaaaacactcagtggacacactgatggataatttagcattgtcacatccacattcaatgtcttccaacttaccttttcaaacctgtctcccctcactcccccctcctcccaacctttttgcctctatgaggaaaaccttcttcaaaacccaggtataagcaatggaagttataagctaaacatttattcacctttatttattaccctagcacctaagctgcactttatacaaagagaatgctcatatttatagaacaaacactgcttatagtctattaactctgcctagggaacccaacaatatagcaatcctttattcctttaacaagacagtgaaattcaattctgatagtaactcaagaaataaccttaaaacatgaagtacttttgcagacctttaacaaaacaacttaaagggataggtttttaacattaatgcttcccgtgatgttttaatgtttctaaaatactgttattcaaatgtatgactacagcacattgctattcttatatgcctctctcaagttctgaccaaaaaaaaggctattcacattaagaatttctacgttgaaagcatacatgcaatgtgtatgttgtaagggggcaaacttcaatcagaaaacatattgccagtacatatcaaagcatcattggcaaatgctgccctgagctctaacacaccagaaatagtttaaagagccctcaaaatatccagctaccctttcccttctcacaactctgcattgatctataacatataccctggaaggctcagctgcaaatgtgtcacaccacttctctgtctgtacatcaagaaatattttttaaaggggtaaaaacggacagaactgaatgcagcaggtcaacatacttaaacttaagaaactcaccaaaactatgagaaaggaagaaactgtataattagtcccaatttaaataagtgaacaatcaaataattgatttgccaaggtaacagagctaataagaggtaaaattctgtctttcaccaagaatcttctgattccaaatccaacaatgctctttctacactgtatcagtcaacaatgaataagaaagaatttactctttggtgtctcctgttgaagatagccatgcttattctcaaatctctacagcaacagatacagatgcctaaactaggctacctgcctgatccttccctggactaaattctgggcctacccaagagacaagctaaagcacaagatcagaagagaacagtgagagtgaggagacagtagttcagtcagcaagtccatgtgaagagggtcaatgaggaatccaggagagacagacgtgtacaattaagaagaaagcaggggcaaggcaatccaggcaagcggtcagaaagactgacagaaggtcctcattacagctcccttaccttgtgcaaaaaaggcaagactctgtctctgggaagcctgactagcgccaagccaggctgagatccaataccaggcaggttatcagaacagtgactctttcacttgttcaacaaaaaaatttattaaaatactcactatgtgccagaaagcatgctaggtactggaagtattcattacacatcgtccctgccttcaaaaggtttaaaccattgagaaaggcagataataaatgatgtattgttgaagatatgcactaggcattatggtaacaactcaaaagtttttaccttaccaaggccagttgcaaggataaagggagaggtgaggaatgggggaaggtcagagaaagaactaagaaagtcctcaatgaggaactcaattattaatataagatagagcaacatggcttctggaatggcatgccgaagccaccctatgactctagtttctaaaacttaaggtaaagatcgtgggttggcagtgtgcaaggactgtcatataatgaaaataagggcagtgtttgaaagagaaaaaaatgcaatgtccataaaatatgaataaacctcaaaaatgtcatcatacagaatactatccagcaataaaagtgaatgaggctggtgcagtggcccacatctacaatcccaaaacttttggaggccacggcagaaggatcacttgagcccaggagtttaaacccagcctgggcaacatagggagatcttgtctctccaaaaaattaaaaacttcaaaattagctaggtgaggtggtgcatgcctgtaatccccgctactcaggaggctgatgtgggaggattgcctgagcccaggaggtcaagactgcagtgagtcatgatcatgtcactgcacttcagcctggacaacagagcgagaccctgtctcaaaaaaaaaaaaaaaaaaaaaaaaacaaatgaagtactgatacatgcaacaatgtggatgaaccttgaacacattatggtaagcgaaataagtgaatcacgaaagaccacatacgatatgagtcaatttatatgaaatgtccagaacaggcaaatctatacagtcagaaagtagattggtggttgcctagaactgagggagttgagggaaaacagagagggattatttatgaacatgacgtttcttttaaggttgacgaaaatgttctaaaaatgactgtagtaatggttgtacaattcttctgaacagatcaaagctgttacaaatatatcattgtatatcataaaacttcaaacataaaaattgcagatggtttatcagccttaagaagccatttgcaagctgggttaagttagcacactaagtatatgagacttaaagcaatgtggaacaaaattcaagctataactgtatcacttgccagctgggcacacttgagcaagctacttaatctgtctgagcctcaatattgtcaactgtaaaataaagacatctaccttgcaaggtgagaaatctgtattgttaccaatttctatatgttagtatatgaaaatgtcatccagaaaattatatgtaaatatgcttttcttaggtactattcaaaggaataaaacataccaacattctaatacaatttttaagtcattcatgtcaagatctacgtttcattcgtctttgtattctgccttacccaggtgcataagacagtactttggatattagaagtactattttctaagtgcttactatggtctaggcattctccttcatgcttcatatatggtgaagtttaatgcaaagcctggtcaatggggggccatgctttttcctctataacacacttacatatttttggtgtcattgtttgtgttttgttgttgttcttcttgttattcctttactattaaccacaagttacatttaaaaatatatttctcagaaaaacttacttgactatgcaagaatctacaatggtgctataaagtgttactatgagaagccctattattttcaacataaaaaacgtagtaaggcatacccggttctctcatttttaagcaaaattttaaaaatatatatgcataatattttagtctgacttactttaattagcaactacatatttctgaaaagctgacatgtctttgctatttttacttcttttttgaagtgtgcaactcattcctaaagaatgagagttgatttgaatgattcaaagttgactaacaatttgtaattaaacaaatttttttaattaacatatccaccattcactttacaacttaaaaccaacaatttagtgtattttaccagttctgcctcttatttcagcactataagaatagtacgtttccaatatatgtgacttttagccatttcaaagatgttagcagagcacaccatcaacgttatatggttagttacaattcataacaaaggaaaagttgaggataatcttaccatatcatccgtcagtgtcctaatatttaaatgctgcaaattaaaaaaaagcaatcatattagtaatttataacagcttctttattttagttaatagggtacattcaaaattctacaatcctaacttgaatataattaaatttctgacagtccaataaaaacacattatatataatcgttttaatctctttctcaaaaagatggacaaaagttaccctgcgtgtgatagttccaaacacttactaaaatttttttactttgtaaaactcacaaactaaaaaattaactatggtacaataaatatattatcccaattaacagtattaattaccattaagtatattaacttagaacacaatgtatctgtctgagaatgagggcacatagaaaaaataaaatgaaaaagaacactggatataaaagattttaatgtgatgatttttcagaaaatttttcatattatagaacagtgaaactttaaatttaccattagtatgcagcataatagataatgaagtactttgctggcttaattaacttaaacaattctagtaacagagaagaatgtactaaaatgactatttgcatctttaacatcagtttgatttatcatgagtggtgacagtagacacttttcaatttcattgctagcttcaaggacccttttgctgatttccttgctagacaaacataagaccattctagagagtgaatagtttcctgcaaaatacaattcaaaagaaaaaaataattatttagagaaaaaacacagaaatctaagttttataagtcccagtgtcgggaaagatattgtattcaagtaactggaatcaattaccaattctcctttctcttattcactggagcattcaatttttaaaggggcagggaaagggtcaaacacattttctaaataggaaacaaggtctactcttttataaggacagatgttaataaccattatctaacagactaagtggtacacagttaaattcaacatttacttaatagaatgaaatttatcattcatgtttgtatactcaagtacaccttcatgctcatgaatctacctcagtgatgatccagattaaaaatctgtacaatgtaaatcaccatcccagattctcttctccctttctttcaccaagatgttccttcttctagtgcaaaggaaagaaggtaacttgtatctaaaatgaattttgtgtataccaaagaaaatgtagccaaatgaaagaccattagccacaccactaggctccagattaaactgccttgttgaattagaatcacctactttgacttgggaataaggaagtaataatagtggattaactaagggttagtatctaataccaggctatagaatttgcttttttatcaatactatcttcagcctttgaaattaacaagtacgcacggtggtccttaaaagtggttgggatcctgagcgggatgtaaagtatgtaaggaacttagggccacagtgtcaccccagagaccattactaaaattaaacccaaacgtagagggctcttgagtttgcagagaaaggagctggggcaatgcctgtgtgaggcgcccttcctctaacagcctgttgtatgtgtgccttcctgccagtagaggcttccagcctattgcatttggttaaccacatttcactcttgttattccacaatcagaggtatcactccaatcacatctcatttcactctcaaaagggttcatttcaagttcctgtgaaaaagaaaaaaaaaagtggcaggtaatgaacttctggcacaatggcatgccaagtggcctaatgcttaaaaagtaaagccaaagaaataaactataaagctgaaatcctatttaggatggtatgccacaataaagagaaaaacatctacttaaacaaataaaatattcccaaaaccagcttgaattgcctcaggaaaatgccataaaagtgatattttaaaaagtaagagtaaaagacaataaaaatagataaataattttaaaataaagacgactagggtccaggcaagatttatgatctaaaaactacataaaagatacagaaagtaaaaggaaaataaaactagacaggaaaataggaaatgtaagttacatgatgcaaaatccagttgtaaacattcaagagaaacacttatatactgtcaaaggtctaaaattagaccatctttttaaaatttcagttgggctcacaacgttcaggaaaaagaacagccactcttatgtaaaaacaaggcaacccagggatccatttttggtcatggttttcttttttttttttttttaatatatacattctgaaactatctcattgagggtatagctttttaaaagatttaatttcctaaaggcttgatctgttttcaaactatataggtatgtacataagcccagttataacctatgttattatatttcccaaagaacatgtgatgaatcacaacagaattaagatgcaggtgtatcctgcatggagaagaaaactcaaagggatgtagatgtggagagtataacagagtctgagagaaaagaaggtcaaattcatcattccttctcttccagagaacacttacctatcaattctcaccatcagcaagagaagtcaatagggcaggaaatcacagcaaattcaagagtccagacgggactggagaaactcactaacagagtaaggagctggaaaactgatctgagaattgtgtttctttctacaccaaaacaataaagtcagaataggtttcatttcaagatttagcttgctgaagaatagagattacatagttatgtacacacatgcaatcttaaaccactaaagataggctagcattaaaaatctaaataaatctaagcactagtaatttcccttaaaaactggaatgtctcatcatagtttactttaaacgtgaattaaagaaaaaataaacactaaatacttagtgaaaaaatgtaaacactatatcaagtggcaatcttttgtaggatgtctgaatgttaatactaaattcaagtttatcattgaaagtttacatgatctcaaggtcctgcctgtttggcttatacacataaaatagggactatccatgaagtagaaattgccaagaagagggagaaaggaagaaaatgactaactaaatcctcagataattctatggggttttagccttacttttgtaaatacaaaactataagggtaatatccttaattaaaattagaaaaaactttgtaacacaaaaatattgattttatggtggtacttgaggtactgtttaaaatgaagtacctctgttttatagccaccagcaatgctctttactgtcttctagttcaggaaaatagttaactgcaaacatcaatccagttcatgagtagccaccgtggacatctactccaaaaaggaaatagaaacataaaaccgactattaaatggaagcaactaggaaacacctttaaaaataataacctgatagcaaatttttagggttatatttaccaaaaaaaaaaaaaaaaaaaagttagaagcatacagttttagacattaaaactttcatatctaaatgtgactttgtgacctttacatatattacctacctggcctatgattctagaggtgttattaatgttttatggcactgaaatcaaataaaactcatgattttaaattataaacaattctgccgggcgcggcggctcacgcctgtaatcccagcactttgggaggcagaggcgggcggatcacgaggtcaggagatcgagaccatcctggctaacacagtgaaaccccgtctctactaaaaatacaaaaaaaaaaattagccgggcgtggtggcgggtgcctgcagtcccagctactcgggaggctgagacaggagaatggcgtgaacccgggaggcggagcttgcagtgagccgagattgtgccactgcactccagcctgggcgacagagcgagactccgtctcaaaaaaaaaaaaaataataataaataaccgttctgtccacaagactactggttattggttaaggtgtgatattaaagaatatgagggctcttttcctaagctaaaaactcatccttcttcctctggtcctatgtttctcaaatactaattctattttctccctaaaaagtaaggagaaccacatacagatgggtaacaatgttttctgttaatgacagttcctaggatgaatggtcaagagggtcactctggaattgaaagagaaaaaaagcctttatagatttttcttcaaaagaacataggagtcggggggaaaaaagtagaaacacagaacatcggtctctatattcccatttaagcaatgcatcaaaacttttattgaagatagtacatgctgtcaaaaaatggatttagagctttcagagaactgtgctaaatgctgtgaatatcaagaggcatgtgaaatagtttccccactaacttagtttacaagtaacaaagacagataaattgtagtacacaaagcaatatacaaacccaggaggtccacacacagtgaaaaagatgccaagctgtagcccaagacttttcgcaaattttatgttttctttcattggttagcatatctgaactagcaggccaatggagcaaaggatctgtccattgatatcattaggaacatgacagccaccatcagattcaagccagtaggcttgcatcaatttattattatcagaaccaaatatgtggtagcatttttaaataatctttggctgacacagtttaattccattaaaattgacttttttttttttttttttttagacacagtcttgctcggtcacccaggctggagtgcagcagtgcacttgatctcaggttcaagtgatgctcctgcctcagcctctcgagtagctgggaccacaggcgtgcaccaccatgcccggctaatttttgtatttttagtggagacagggtttcgccatgttggccagactagtctcgaaatcctgacctcaggtgatcctcccacctcggcctcccaaagtgctgggattaaaggagtgagccaccacgcctggccaaaaatttacgtcatttaagtgggttatgagggattaccaacatgaggaaaacttgtaagattaaagactcagacacaattttcataagctagatcctccggaccagctggtttttccaggtttttgtttgtttggcgtgcacaagaatcacaccaagactttctctgaaaagctagattagagggcctcagtctaccaatattcttattcagtaagtctaaggtgggacctgggaacccacatgtttaagaagtcatgcctgtaatgatgtggcagcatgcccaggaccacgtgagaaaccctactccatactccaccactatcagccattaaacattccctcagcctgcacacatatgaatttctcatcatgtagctcactttaaaaactggacatacctgaaacaagccacatgaagggtatagataagaagtacaagagtatttcaaagaagtgaaaacagagagctgataaagttgggacaggccttactgccatgaagtgaaaggtaccaattagcactgttttaagataattcaacaatctctggtatgtatgatgaattaccaattgcatcatttatttaaatgcttagtctaaggtacaaatcattcagtctcataaacataaacttagtacctaagtattaaagattgttcattgtatcagactatgacatgataccatttgcttgacaaaatgaataaatcacaggttactaacaggaaggaaggagaaggagaaggagaaggagaagaaggggaagagggaagagggaagagggaagagggaagaggggaggggaggggaggatatcttaaagaaaaaaggaaaggattagtcttctcttaatcatcttctcttaatcataatctatggctgataataggttgagatgttgctcacatttttgttttgaagtccagattattcctttccaacaataatgtatgaatatgtacttcaatctgataacatttctagcccacacacctgtgtttatcttaacgtcaacaccaattataaagactatgaaaatttaaagtaatattcctaccagccatgactctcgacacacctacagagtctatggatcatctccctggcaactacacaacacacatagatgtgaaaatattattcttcaagggctccagatttaacatctaagaaaggtccaaaaataatactgaagctttcatagcactgaggacaagagtagagctggctctttgatactacaaagaaaaacttttaagttgacatgttttttcagtccaaggtggaaaaaagtgaaaggggagatgttaggaacaggtgagaattaggaaaagctctccagcctcttttaatctgctcatttattcaaaactgcaattctgccaacctcagaaagacaaacataccatgtattactcactatccaaagcttctctactgtcatgcactcaagtatccagacctccctgcccctcaattcctccatcgtgaaaggagagccaacgagagatcagcgttaaggagaaggcatcattcaagtgtccacagcagtgaaaagatgcatttctctgagaacacaaggtttaaggaggcaacatacctgctaggaaagaactgcctctgtagaaaaaaacaattatcatattgtggcttgggactctgacctagattgcaccccacagaggctaacctaacaagtcatttttcattctaacataactccaatattctttttccttgaatgaactcattcaatgttggggtaaaataaaaggaaaaatataatggctaatttagtaacacagcttttgtacatattttaagatgcctcttcgtctatttcagttcttttcacctatactaccagatgaaaaactcttttgcaacatgtccagggaaaagcaaatcgaatctctgaaccactttacaagtaggttcagttctaggttatgggaatccaagacctttttcattgtctggagaaggctgaaaagcatttacagtatttgctatacagagaattagagatcccagaactcccagagtcaccttgaagcttatcgcaactactaaattacttctgagagtggcttagcatcctagacatcttgtccacaacacaaatttagattggatgttcctgagactgacagagcatcacccattctttcacatatatttgagaaagattttgtttatatttcagcatcaccataaaggaaatttggttaaaccattttaggaaacaatttggtaaaacaaatcccatgttcacactttaacctaataattctacttctagaatccatacttgggaattaagaaatacaatcaaaagtttatatacaaatatgtatcactacagcattactttaaatagctagaactgtaatcagcctgagatttccccaaacataggaaagattaaataaatcacagtcctaccaatatgaactataatgacatggaaaaatgcttacaatacaatggtacatgaaaaaaagtgcatttaaaattgcatatgtaacataattccaacttcattaatatacatatatatggaaaaaataaaacaggaatcataggtaattttacacatctggattatgggatttgtgggtttttttcatatcttcatgtattttcccagttgtctcaataagcatatttacttttaatacagaaagtattttttaagttactatggataatacttttcagattgagcagaaaatacagattgttccttttcaaataaaaatgtatgtattagtaaaagaaaaaatgaaaatctaaaaaacatctaataaatatgtgcacagactttttaataggctagttttttaatgcatattttcaagtatgtcagaatatattaagcacattattcgtctgttttctaattcacatatataaattatccaatctcaaaaagctccttggttctgtgaattattgatgttgtcacctgctacagacttaattccaagaaaaatatacgaatcactacatcacaagcacaaatccttttgacacaaattcaatttctgtggcaacaataatatattgactttgctttatttttctactttatgacacttattaatggcagagttaaaagaaatctatcatttttctttattgtaaatgtaaatgatatcatgccatcttgagaaagttagggtaaataccacttactagataattccttaatgtaaataaggtcatgatgccaaaatataagaaataaaagataaagattttaagcaagacctagtctcataattctaattttttctactacacaattaggccaacatgtgtgagacacatcattaaatatgaagacccagtctctccccttacaagcttgcaaccaaaagaacaagataaaccaataaccaaaatgcttcataataaggtattcaatggtgattggaagaaaagcggagtctccacctgctaatcatatatgcttaaatgcatgctaattaacaggcaagcattatagcaatgatctaagactaaaggcaaataaaattttagccatgattcaggtaaaacttggaatgtagaatttgttcttctaacagaatgaaagattcctaaaacattcattcatgcaacaactgttaattaaatattgctatattcttgacaagggagagatcaataaataaaacaaagatttttgccctaaaagaacttatctttattggggaaacagacaataagcacaataagtaaattacttatttaagatgttagaaggtgatgaatgctctgataaaaataaaaagtagcataagccaagagggtttgcaggttgcaattttaaacatggggaattgaggtaggcataggcctcattgacaaagtggtgtttgagcagagttgccagtgggctaaggtgtcatctatatggatgggcaggggagtgtttgcaatagaaaaaacagccataacaaggctgtcaggaggagtatgcctgatgttcaagaaacaagggagcttgttggctccaacaggacaaaatgaagtcagtgagagggaaggaggaggcagatcagtcccagaccatttcaaagacgtgggcttttacttttctaactgaatagtcacaaatattttgtaagtatacaaatataaataaccaacttacacagtaaataataatcagatcagcatattcagcatattatacaaattactgaaggtagggaggaaggtctgtactcaaataatcattatttacttgagggccctttaagtggcttagttatgcttccaggagtcatttaccagaaggtattagaaatactctcaaaacactgtaaagccaataaaggcaatttttggaaaaactcagttaattctatcaattatttttttaatatggaattagtctagggggtagagggaccagtttagcatgtctagagaaaaaacagtaagaaaaacagtatttacaacaatttaaacataactctgaggacccctcggaagtttgagcgccaaccctaaggagtccccccaagaggtctacatgcagatggtaatgtgctccacacgtgtgcgagtcccagcaacagggacccttgtagacagcccagcaccagccatggttgcccctcctccagctcctaccatcagggactctttcccttcctgcagttaataatctctgatttacctcagcatctccaatatgcccttttcctttcttttttattttttattattttttttagagacagggtcttgctgtgtcgcccaagctggaatgcaatggagggatcatagctcactgcagtctcgaactactgagctcaagcgatcagcttcccaagtagctgggattacaagagcacaccaccatgccccacattttttttttctttttttttttatagacggcggtcccactatgttgcccagactggtcttaaactcctagcctcaagtgatccttctgcctcagccttccaaaatgctgggattacagtaaggtgtgagtccacctcatccggccagcctttctcttttaatactttcctaaataatcctcaccttaaaccaacctaccttggtttctgtttatttctgggccttgaccaagacactaccgcagtcctctccctctcaatacctggctcacctttcaaatgctgcctgattcaggaaggttctctaagcttgcccacatcaagcgtgccttcctagcacttttacatcctgccttgcactgtggcacaatagagcagtactgagcagaggtgaacagcctcggctctgggataagactcacctggatcagaatccagctctgataccaatcatctgtgtgatcttgagcacttaaactctctgagcctgaatttcttaactgtactatgaggcaaacaagcatcttccccataggcttggtagaagacttatagaaaagaccatggtacacaaaatactacacctgaggttcagaaactttgaccaatgttattctgcttccttcacagtaagatccatataggcatcacctgggttcagctcactcattctcaaggatactcccaatagtcttctcctcctctagggccccataaccagtctgtaatccatctaaatccattttaaatgtgtactgcctctcctgtgggcttgatttttgtcatggtcaatttaccagcagctctgttttgctgggtgtcagttatgttgggctgccctctggggcctttcacatgctgtcatatttctttggggctcaaatatgggggttgaaaaatctatgcagtggcagtttcctaatgccatccccagagccagcatgttgccagggcctcaggagactcacagtcagatggacgaatcagatgtgaggtaaacagattaagtaggtactgcagataaaaatttagagtaagggtggatcaaccttcattattatggagaaatgatctcatttccttcttcccacagcccttttgtttacaattcccttgggtcaccgataatggtttgtcttgcagtttgtgtttatacctccttttctgtttgtatgtcgcaggtactatgttcccctcaactttgaatccccagccctaccatggtgcagggaacattttaggcagtggttatcaacctgactacatatgagaatcacctgaaagcttgttttcttttcccaatacggatgcctatgtaatatcccagcccaaatgaatcaatacccaaagatggagcctgccatggataattttaaaggtccccaggtaactctaatgtgcaacctggaaacaaaactactaaaactaggcaaactattttagactcagtctttcagcaccaagactgtcatcaagaaatctccaaagatccccacatgtaaacaaggtagacacctgtgggtgtatctgcctcctgcacactgtctcttctctgagaatgcctatgccatagaggtaggcccaccagtcttcactgttccttgtaagccagccctagccgcagctaaacacaaggcagaatataaacccaagcagagccaatcaaatctccattttcccagaattctagaattggaattcagatatgaaaatcaggctctactcttgcacggaccaaggacatgtatgtctatctggaattatgaggttctaggcttggctgtgtgaagatcaaagcagaggaagccacacaatgcagagaatcaacagtggagctatgcctagtgagaagcaaagagacactggatggcctgagagggaaagagactgagaaaagctgtcagcttttagttcctggttccagtcctttgtgacggccagcttgattagaggtgctactcttgtgtatctttacaattcctcctttcaggattacagtagatattgtatagggatctgttcctttagaccaaatgggcctttaactgagacagaacccaagattgctaaatgggtccctaggtacccatatgatacagcccaccttatcactactactacaccttactggacactttgcgattactagtatacccagcaaccctaaaaactcgctattatccccatcttagagaacaggaaattgaacagcacagaagtgacttataagggttggtgagtacctaggctgggaatgagtcaaaaatccagcctcactctccttcctttccctcagtccccagaactatgatgggacagccagctgctgaagcagtttctgaattatttatggagcaaagaattcaaaaatgaaatcttaacaagaaagatgagcataattccaattggatgattactaaatgataacaacaacactgactacaaaaccacaccttaaaaccaggcgcagtggctcacgcctgtaatcccagcagggaggctgaggcgggtggatcacaaggtcaggagatcgagaccatcctggctaacacagtgaaaccccgtctctactaaaaaaaatacaaaaaattagctgggcgtggtggcgggcacctgtagtcccagctacttgggaggctgaggcaggagaatgacgtgaactcagaggcggagcttgcagtgagctgagatcgtgccactgcactccagcctgggtgacagagcgagactccgtctcaaaaaacaaaacctcaaagataaatgggcatggaggggggttgcaatttctgtcaattgactaacactaataagaatacatggtttgctagggtgtttcctcctttttttttttaagttgctctcaaatgtgtaatagaaatgaaaagcttttttatttctcatttatagatttttaaagctggggtatataccacaaaccttataaaccatacactcccaattcagactgaaacataagccaaaattatccacattccaacatgtcactaaaaaatgcttgtcaggaattataatacaacagctaaagaaaatttaatttcttaaattattgataaagtttgaacttattctaaataactgaattaccattaagttttcttgtataatttaatactacttattacaccctctaagttgttttatctcttaaaaggaatcaaaaagatgattacatatttataaaatgagcatctgaaaaatgaagagcacaattccagtttttacatgcagttccagtactacgcataagatgtaggttaccttttacatttctttcagaaatattaaccaaacaggatatagttactgcacatctaagttaccaggccaccaggtgcaggctgggtcataaagacctataaaatatggtacctgccctgaagaagtttacaatccaataagttctagaggaaaaagaaataagctgggtcatttattttcccttcttggtgattcaaaaaaacaatataacattagtaactgcctgccagagctaaacatactgaaaaacacagattcatctccttaatgctttcctttgcacttgtcatccaaagcaatgtggggaatttggagagagaaattctagaatgggatttgatacagagcggcccaatactgtacctaatttgcactgtgccatatgcaatacagtgaaatcctaacacattacagtctatattgcagtctggttatgaacacaccaatttctgtagtccagccacaagctcaagcaactgcagcctaactgtccttggaaatcctccaacaatgccaaaggagacttcagcaatgatttaagcatatttgtataggacttttaaaagtacaatagttttaggttgattatcgcaccattcaaacacactaataaaaaaaggcaacaaggtttgcaggaagtcagcagctgatagccacaggtaagggaaggcacccattgatcctaataatctagtgaaaattactaaggactgcagatctcacaaggatgtgaagataattctcacatgcctgtttctgtcatcactgatgttgtttcactcgtaaacttattgagggtagctccataggctataaaactgcatcatctttgccagaataaaatgtccatgttatctataagagttaaatcacgttactggaaggtagtctataagaaacacctgactcacaggtgaagcctccaaggcccataggtagtccctttaaacttgaatgtaggcaaatgtctgtcagctgaagaactaggaaaaaaaatgctgccaagaataccataggaaaattctcagcatgtgtcttcaacttgtgcaaattcctatttacagagaaaaggtcatttggaaaatatagccatttttggaagactgagcagccaaggttcttaagtataggagattgggacaaaacaaaaaaaaggtaaatttgttcatcaatctacttggtacatgtttggaactagagactcaaatagggaaaatttgctcttgggcctccccttcccctctatcagataagtaaggctaacagaaacttcaatctgtaaggtacagtacagtgagattagtgctataactgacactgatctaagcattccagaagatctgcttacagataccagggaacacctcagggtccagatttgcttcaagcatgcacagaggacactggaatggaccaaaccagcacagagcaaaagctttctagacaggaggtctagcttgtaaaaatacattgcaatcatgcagggacctacaagtaaattgtatgaataggaactggaatttcaggtggaagttgagggatccaatctagaaatgtgggcaatgacaaaatttaaaggacaagatcatgctacttggcctttaagttgtggatgatgcaggagagaaactgaagggttttaagcaggttccataatcacacttgggttccaaagaaaactattgtagcagcaacatggtggataaaacagagtagacccaagaacgagagccaaggaaatcagttaggaagctattgcaatctattgcaataacccagcagagagatggaaggtaagatagatgaggtcagggacagtaggagaagagaagaggcaagtgctataagtacccaggaagcataatcaaggttactggataaccaatgcatatggaagttaaagatcaagaagttgaaaataaatccaaggataaaatgttgacactgactaagagaatacaaaagaaagaagtttatgagaaagcagataaattcgagttgagatacagtgagtttgaggtacctctaagccatccatgtaaaataaggttgaatattttggacaaaagctcaaaagaccatcctaaaataaagatggagttttaagaagtcatcagcttctaaatctgagctgtccaatatgctagccattagccacatatggctatttaaacacaacttaattcaaattacacaaattaaaaattcagctctttggtagcagtagccacattcaagtgctcaaaagccacatatagctagtgactatcaaattggacatggcaggacacaacatttccatcatttcagaaagcactaatctaagtggtagtaaaagctaaagaaatggatgagttcacactagaagcacgtataaagtaaaaagagaaaatcaaagagattacttggaaagactcattttaaaggatagggaaaggaataaccaaagatcagaagagaagaacatgttagaccatggtttcaaggggggcaaggtttgtacaaatacaatgaagaagtcatatagggtgaggcttaagacaaaaatcagcactgggtttggcagttgatctgcctgggcaacagagcaagaccctgactcaaaaaaaagcccaagttaactccacagcctgagttcttaaagattatgctacatgaactccccagcaacactgtagtatgtgttgattcacacctctctttccccataccagactgaatataaacctcttgaaatcaaggaccaaattgcatctacccgtgtgctatgctcagtataactggcattcaaaaatttaccgaataaatgaaaacaagtaattcacagaaagtggctaaaaaggaaggaagcagagcatggtattcagagagacaaagggtcaagggaaagttgaggaaaggggttgtttggttttccttctgctttttctttcacaatggtaaacatttcagcaccattacaggatggagcgtgtaaaaagcaaaaccttcctgacagaatgtggatgggccaaaaacagcagtaaagagattaacctcaaataggaaaatatattccttgtgtggatattggaggagaaacaatgaagaatggtcgcagatatagacaattacagcaagctctaggaaaactttctctgaaaaaggtatcaaggggcatgctaagagtcaggagtaatcattcctaagatcttaagcgaatgctgtggtatgttcccatgtgggaaaaaagtgggtgcttgacatacacacagaatatcattggaaggatacaaaagagctaggtgcagtggctcacatctacaatcccagcactttaagaggctgaggtagaagaactactttagcccaagagttcaagacaagccagggcaacacgatgagaccctgtctctataaaatataaataaataaattagccaagcggtgcagcgtgcctgtagtcccagctactccagaagctgaggtgggaggatcacatgagcccaagaggtgaaggctgcagtgagccatgattgtaccactgcacgccagcctgggtgacagagtgagacactgtctcaaaaaaaaaaaaaaaaaaagatataaaagaaaataataagctaaccagcagcccttggggctgctctgcctatggagtagccatcttttgtttctttacttctctgatactttctttcatgttaaaaaagaaaaaataataaatgtcatcatggcaggtggtggggagggggaccttaattggtggtctaggatggaagggaggcttagggaatttcccctttgtactcctacattgttggactttttaagaagtacagatgttgtttttcagtttatttattttttgagacaggatcccgctctgtttcccagactggagtgcagtgacacaatcatggctcactgcaaccacagctttcgaggttcaagcaatcctcccacctcagccttccaagcagctgggacttcagaaatgcaccaccacgccaggctaacgtttttgtatttttttgtacagacggggtttcaccatgttgcccaggctggtcgtgaattcctggactcaagcaatccacctgctttggcctcacaaagtgctgggattatagacatgagccaccgcgcctggccgctttttcaattaaaaaaaactatttgggacaaaaaagaatcaggccaatagatgagataaagaagtgataggtttagcataaatgctgtgagaaattgaaaaggagatgaccaaagagctagtgaaaagtcaggacccatcatgccctattcccagttaatctctctgtgtctcaaccccctcatgtgcaaaataacagtagggagagtgcccatttcaaagtactgtgtgagggataagtgattaaaatagtgcccagcccgttgtatgagctgaacaaatgcggttattgtgatgatgattgttatctagcagcactgaggacacacagatacccagtgtctaagggcatcagttcacaaagctgggagtggtttccaccaggatgcaggaacccagttcagccacagaagcctgccaggttgctccaggcttggagatctgaggcaactgaacaaggaggccaaaggttctattatttattgatattctaccttatgtgaggtgtgaggaagtgaggagtttgaaggcatcccagttcaaagggagctccatggttacttttgtggagtgtgggtttagtgtggagcaaatgttgacagcaggaggcagacagagaaagagaggcaatgtacagaggctgtagtaggtctacatgaaacagaaaggaagggaatatatccaggcaccaaacaaacctctggtgtgtgtcccactgcaatgaatggctgagtccctggacacaataccagtgtcccccaggaaaaaaaaaaaaaaaagctatgaggataaaggaagtaggaagcaggaagaagaggttaaaatactgtcaataactgagaacttaacactatagtgatgaggtctcccctattaataatagttgtcacatattaattgtgctgtgcctaagctatcgtaacatgtgttaactcaactaatcctcacaacaatctataagcaaacagactaattacttccattttatagaagggaaaacagaggcacaaaggttgataatttgcccaaggatatacagacacgtttgagtctctctcaagtctttttatcacagtttaagggtgggacttcagagccacattgccaggcccaagttcttcaataacccacatatgtttctggtagtctttacatacccttgcccaccaccactaggatcttttataaaaagaaatgagtaattattaataacatttaaacaaattcatcatgaatgggttaatgaaccaggcaatataaagttacaagagtactttgttttgattttcaattagccaaacattcagattcctactgtaagcacaagtctataccaggcaccacacagaaagtgacttccaaaagcttacaaacacatgtataaagtaactaaaagcaggttcaatataacataacaataagagcaaaattataccctcaaaagagactgagtggagttagaacatggttttaattggagaccgtcaccttttataaagaagtgaaatagtcatattgaatttctcaatgcagattatatgcactccatttttcatgttcatttcccaggctgtcaattttttcattaaaaaagaattgtaattgtcattatgcaaggaattcaatcaaaggttttaataaacaaaaacagtttaattctatagtaaagtccataattaatgtcaccaatttgcaaatcttttacttaaaaactgaatgttacaaagtttcattttatgacacccaaataaacagccaacctcggaaaaaaatgcagcaattacgggataaactctctgtatcttgggaagatacttcataataaaattaactaaataaatgcagcattatggatctcacaattaatctactcagggcttttactaagggcttcaagaaattctacaccataactcctttgacagaactatgactgaacaggtattcagtcttctttaattcaagagggtgtgtacttagaccacagctacttggatatatcccacatccctcagcacacagaatgacctcacacttggtacattaattcatagtctcccccttcctttccagtatttaagatctgtcatgatcctcaaagatggagagatcagaaagctactgagtattaattccattcacagatttacttttagggaaagatatatatatatatatataaattggaaccctaaaaaaatcaaaattgaatttaaaaaaatcaaaattgaattaaaaaaaaaagccctgtaaacccaggaaatgaagagtaaagattagaaggagataaagataagaagggagaaaatgaacatttcaatggaatttatgatatttaatgttttaagcttattagtgagtatacagtgttttacacctcttttgtatgatacatacatgataaaatatatttttttaaagattgcaagtttcttatttaaccaaaaaaactattagaagcaaactgttttgaaacacattgtatacatccttcactactgatacttactaatcacttttacctcatcactaaacaaaggactaaggtgaaaaacatttgcctggttcaggtacacatctaatttcttaactcaagtcatctctgggtaccccaaactgtggtctacagaggccttccacaaattctacttaagtcttatgttttttcaagattatcttaaacattagaactaaagtaagcatattctggacattgtgaatgacccactctataaccatgttctctcaggaacttttggttttacttttgtaaatacttttgtatttactaccaatatggttctcaatgagggccaagcaacatcatgacacaatagattttcacaagctcttccacttaggaagagttcagttccaaatggctatttataattccaaaatcacattattctggaaactatgcacccacaggtatggaaaattagatttcaagagaaaaatgaatatagaagctggaagtataagagtttttattttttctgctgcttcaacagttttataacatttactaaaaaatgtttatatatggctattttctttttaaaaacaggtttataacagttcactacttcatctacatcctcaagccaacacctatgaaaaagataatggtgtccgatgacaggcctctgctaacagtgtaaggctatctgtgaactcctcagtctacacatatcttcctcagcctctgggattccatttccacccaagaattaaattgatagaaagaaaaacagcaaaatatacacatatttttccactattaaatccaataatgatgacttaatttcagcaaaacatcatcaatcgcattaaattaatgttgctgttaatttgaattttatgggttttatagttttgttttggattgtagatgtaaatctgttttagttttatagctgtaaaaagtgataggcataaagagttacacttagttttatatctgtacatatattagtaacattatttttattatcattcaagtccatattggagtatcacaagaattttttttcctaagtttgaagttgtttcctttatacgtttttttgtaagttacatttgtaccccaagtttcatcatcctattatccccactttagacataaagaacaggcccctaagaaagcttcagaaacttgctctgaccattcagtcatcagatcagaactctgcatcaatccaaatgttacctggtatgccaggataagaactaagaacagaatggctctgcctccagcacaccaagaggaaatagcctggttcaattaagttttccaagattagaaagcttttcaaatatccaatgtattcctaatgccctaaagtgtaggcaaaaattgtactattattactgttactactaatgataacaaaaacaacaatcctataaatggcaaatatttccatagaggttacaatgagccaggtattctaggcccaaaacataacttttaatcttcatgacaaccccatgttacacatgagaaaggggaggcacagagaacggttaagtaattgctcagttcacacagctaataagtgatattgctgggattcaacccctgagagtggttcaagtcactgctcataaatgttactcataacgcttcttctacaaaaaactgtaagaaaagatagcagtgggtcttttgaagaataaaatctatggcaagcatttccaaatagatttcactaagtaactagtaacatgaatgtttcaggaccaaagcttatttaaactcttaaattctcccctaagttaataaagactattcaatttgctatttgagaaaaattactcccaatggtaaggtatttcaatgccatcctgctgctactgaaagaaaagttacctttgtagatcctgttcaaagaaagcccatgctttgatccttaatatcccatgaagtaaaaggttatgcttaatctatattttatagatctaaaagtcaaattagtttctgagataaacaagcaagagtgtaaggataagcatattctttagcattcatttgattcctagtttagaggatactatgtgctaagttaaagacaattacattagtgtaatacgtagcagttttttcctgtattattctgcagcataaacaagttagacacatgttaatttacattctatataaaaagccaattttaaatccaatttataaggcaataaatatataaagattctaggacacagcaataaagttacgccataaagtagagttaattcaagacaacaataataaaagcatgacaaattttagcattccaccaactgcacaaaggtgtttcaggtaacatctgttcagaagcaattgctacaagatagactagatgagatgcaaggtttcaccatgtaataaatgtatgtcagtttgcttgcttcataattaaagacatgagtctttgaaaaaagcaattaagccctgttctaaatctgagacaatcatccctatctctacccccacccctttttaccgtcaaagaaaagacccagagtggtccaggagtattaaatgccatatgttatctactttcagcaactaaatgtatcccccaaaaagccacttaatatatattgtttcttttgataaatcatttatttaaaaaaatttctgggtttttctgttttattaagaaggatagaaaggaaagaatggctgggaaaattcagagcaatttcttagaacagcagcctgaataaaatgattttacctccttctgaagcttacaatgcctggtgtgtgttaggtagaattctgacacgaataaaatttaggtgcctaaagctttcaactaaaaacagtatctcaattcttgacagtttaaccctaggacaactgagagcatcacttaagctgagaactcaatgaaggaacaagttcaaaaaatcaaaaagagcatttagatatcacctccatcttttcccagcttcctagaaactataaatacagagtagacaaaacatgaatggaggttttggttgttattccagtggtggtttatttttctattgtaatttggttatcgtctgtcctcccaaattacaaacaaaccctctgaaataaagtgaaggcagagatttaaatgaatctgatggtcctccttgtaactatacctagcttcatttcctatggcaggtgtaacacattaccacaaactggcagcttaaaacaacagaaattcattctctcagttctggaggcctgaagtcccaaatcagtttcactgtgccaaaatgaaggcaggctgctctccttctagaagctctaggggagtagccttccttgactcttccagcttcagatggctgcattaccaatctctgcctctgcagtcacaacactctctcctcttctgtggtcaaataacaatacatgtgtttgcatttaggggccactgtgataatccagaataatctcattttaaaatccttaatcatctgtgtaaagtcctttaaaaaagaaaacaggagaaaaggcatacaaaggtattatgtgcaagtgtggcaagtgtggagtcatacaaagtatgaaactcaaacaagggccagatggctaaatcttaaataccctcttcatagggaagagggaagtggggtatgtaaggcaatttacaggatgagtaaataatctttaggggggatgaatgggcccaaagaagagatgaaagtctgagacaaagtttatctgggcttggtgtggtgtcaactccaatcttccttcagtatacatctatttgacttgagatgtctgggaaagagattcacaagttgaatatcttctggaggatacaacctttaggtagataggggaacttcagagaagaccctttcttgcatttctggctccccaggttctctcgatttgaagtccaaagtggcatatttgggggtataattttctgagccctaacaatgctttctttctcagattagtatcataagctccaaacagaagttgcttaaataagtgcgttttctttttctcccagtacaagatgtctggtggcaggtaagttcccaggttaacctaacctatagtggcccagagacccagatccttcatatatatatatatatatatattttttttttttttttttttgagacagaggagtctcactctgtcacccaggctggagtgcagtggcacaatctcgtctcactgcaacctttgcctcccagattcaagcgattctcctgactcagcctccggagtaggtgggattacaggcgcccactgccacgtctggctaattttggtatttttagtagagacggggtttcaccatgttggccaggctgtcatcgaactcctggcctcaagtgatccgcctgccttggcctcccaaagtgctgggattacaggcatgcaccaccgtacccaaccccttcctatattcttgctctgccatatgtagcgcagtacatgggccttgtcttcaggctagctatcctcatgaccagaagactatggcaaaataagcatcacatcctgactatggccaaaggcaaaaaatgggctattgcttcttgttagcctttttctttcagatgttgtatttttcaatgctagaatttccactgtggtctttttatagtttctgtttctctacagaggtttcctatcatttcattcattgtgagcatatttcatttatattcttaaatatggttatacaactgctttaaaatccttgtctattaatgcttacaactgagttatcttgagactggtctccattgattcctttttcttgtttgtatgggtcacattttcctgttttttcctaatgtcaaatacctttgcactgtatcctgaacattgtgaatgtatggtgtagggactctgaattccttctattcttctgagaagtattgctttttgtgtttgttttagcaggcagttaacttggctgaactctcaaactgcacatactgtcccatccgctggatgggacctgaaatcttagttcagatatgttagccctacctgtgctgcttggagtctgtcccatacatgtagggttcagaaatttgaggactctacacacagaatttggggctacccatttgtggctccttctcctctccaggattttctcctcatttatcagctatatggtcaccagaactctgccctctggttttttatgccagtacaactgtgggcttatattctagttttaaccaccccacatgaccctgattaggggcttcccttatgcaaaaagctacaaaaaatgacaaacttatccagtgctagtcccttcttccaagtattgtctccaatagccatgtcttttgatcactctccagtgttttaatagttgctttttataattttgtcatgtgagaggtctgtggtccaatgagatctcagccaatactggatgcaaagtttttgttagttcctttttacagagcaaagacatctttctcagaattccccagcagatttctcctttagcttactggctagaattgttttcatctgctctttgttaatcctctttgttctggggcctgcatgcctggaaggatttggctgcaacacactggctggtatacattaatgagttgggttacagcttattcattaagcttgtgagcttagttaatgtgtatccacctcagacatagattcaatctccatgtgctgaccatatcactgtccaaggccccagatgtccagatgtgtggaactttggggctgcctcctcctggtggagttcaacaggcccaggcagaggttgcttgaaccacctgtggttgccccagctaaaaggggagaagcagccacattccacaatctggactggctgggaagctgagcagggagttctagagtggcagcccaaactcaggcaggcaagcactgaaggatggttcctcatcctcccagcaggaggttggaggctatgagataccctgtctctcaggggctggaagagcaaagagcagtatctctttcagacatcctgctgtcagaagttacaccacagcacagtcatacattgggtttaattgttgctcctgcctggcccctcttaaaaaaaaaaaaaaaaaaaaaaaaaaccaaataacctgtaaagtcattttttgccatataaggtaacattcacaggttccagggattaaggagtgtctacctttcagaagatcattgttcggcctactacacctgcttccaaataacccaaagtaattggcaaacatgcactaatctcattaagcttactgggatttcatctgtactcaaattcctactacgtgtacaatcaacaaaaattctccaaccttgtatatcttctcacctcgcagcctgcctataatcagaaaatcaattctatattcatattatatattaattaaaggcatcactaattattgctaatggttcctggatgagaaaagaagcagtaaagattaaagttcccaacagctatgggagagaattcaggacagtgattaagaatgtgtattctaggccaggtgcgatggctcacgcctgtaatcccagcactttgggaggccgaagcgggtggatcacttgaggtcaggagttcaagacctgcctggccaacatggtgaagcctcatctctactaaaaatacaaaattagccgggcgtagtgacacgtgcctgtaatcccagttactagaaggctgaggcaggagaactgcttgagcccaggaggtagaggttgcagtgagccaagattgtgccactgcactcctgtctgggcaacagaatgagactttgtctcacaaaaaaaaaaaaagaaagaaagaaagaatgtatactctgaagccagcttgcctagattcaaatctcagcctcatgaactggcagctgtgtgattttaggcagcttaatctctgtgtaccttggtttcctcctatggcaaacaagattaataatactacctacctcacaaggttgttctaagaattaaaggagttgataattacaacgcacctagaacagtgcttggctcactcagaaaggttaactagtattaccatcaatgcccaaacatggtaaatatacagaaattaaaggacaaggtgaaaaaatctcaaaaccggccaggcgcggtggctcacgcctgtaatcccagcactttgggaggccgaggtgggcggatcacgaggtcaggagttcgagaccatcctggttaacacggttaaccccgtctccactaaaaatacaaaaaattagccgggcgttgcggtgggcacctgtagtcccaactactcgggaggctgaggcaggagaatggcatgaacccgagaggcggagcttgcagtgagccgagatcacgcctctgcactccagcctgggcgacagagcaagactccgtctcaaaaaaagaaaaaaaagaaaagaaaaatctcaaaaccaacactgaaggtactacaatgacataatcaatcaataattaacaatctatttgatggaaacgattagacgatttacactgaagtctgtgagaacttttagaggactctcctaattaaaaagaactccttcatcaacttggaccaccaatttacaggctccctttgaatggactgacctacatcctagagatggacacttctagaagccacatgtcctgctctgccaccactacctgtgtgttgccaagagtaatgagaaacaggtattactgaaaggctttccacaatctgtaggacaactgttctgttctacaaaggatataggactcaggtccaggtattgagtgtggcctagggcaggttccaagtttaattcctacggaattttatctgccttcacaaagtctccacccagatacttgccctgtcctctcagcctcctccatctctcttctatgccccagtagctatccctaccatctcaatgctcacggcttaagatattttcaaatgagaccaagttggttaattcacaagcatcccaaagtcaattgattcgtagcacagccaaagtatcatacaattacaatagactaatttctactatttatacttatctatgggaagagatatctaagctacaaactcttttacccaactcacaagtgacttgaagcccgcaactatacatttggtagaaaacaagaatttgccaactttaacaggactcaaagtaaaacaagatttcagcgggtaccagagctcctgctttcttacactaagataggagggagtgaccagtctaccactccattctactactcgcttgctgctttgcagaagtgtgcaaaacactggccacctaaattactcctatccatcacatcaccaacctatattacttgttcccatcaaaaacagctgccccaggctcagataatgactgggtgacctgaaaagatttaggataacgtcacttcatccaatcaagaaaaagccaagaactaacttgacatctgcaagaacagtgactgacttgacacctacaagtacaattactttctgaggcattgctgggaactttgatggtctcaaagatccctctccatccaaaaaacaagagttactggtgtgcaatcaagagcagtgaaaggtaggcaaactgggaagagctgctcaggaagcagtcttgagactgggatactgaactttagtacaggaacagagtagagctgtgcctggaacttctgcccatgttaagatttccagttcaacaggaaggtggtccaaaatcagtagcatgcccaggctccttggcagacaaactcaaactatctccaaagaaaagcatctctggaatcctacaggtgaagataaagcaatgagcttacaaagataaatacacacaagaaagagagcaagccatcatgaatctgagtcaatgtagacagcccaggttgcaaacagcagaactgtcaaataaagaataagaacaatcaagtaggaaatgtctaaagaaataaatgaataagaaacaaaggactatcaagaatgcccagacagatttgaaaaataagcaaatggaacttattaaaataaaaaataattgctaaaatcaaatattcagaaaagtagcagattagacatagctgataacaaaattaatgaactggaagatataactaaagaaattaccatataagcaagaacctaaattagtttcaaagtaccaagagtccaaattacttctaaattaactggaagtcatgattcataccagactcccacccaaaaacacagtgttttagatgtgttttttacctttacagcttaagagtgttatcttttagatgtcatttcatctttatgagaatccatttaacaaatggcatgctgagatggtcaatgtgacatacataagaatgaaaaacagcacagagactggaaaccaaatgatgaaatccttcaatgaaacttaacataaatactaatttagatcctgttttcatgacctccttgctgggaatgagtcacagaaaataacacctcctgtattctggaccacagaagttaaaacaaaataaaataagattattaacccagagagtagactataaaaggaagaaaagtcattgccttagtggattcttctcacattaggcaaaaatctttcattgggaagttaactctgtcctattcattcttcagatttgtcaagataatgatcaagtccatacttgatccttctgcaaaatgtcactattcctatgaccattttgatacttaatttggcataattaatctatgctgttcctcattttcaattaatctatgctgtttctcattttcagtattctgatatatctcatgtatcagaatatgggctctcagtcttattcaactattatttttaactaaatgttatagttagcaactggttcacaaaccattattcccttaatttgtgaatcatgacttaaatttctcacaatttttacttgcccacataaggcaaatgctgtactctctctctctctctctctctctctcacacacacacacacacacacacacacacacacacagtttttccatattcctaaggaaaatggtggagtggtcaatgtgaaatttcaattctgttggactcatcccaaatctatcaaccctctatgtgatttatttacacacacaaaccccaaaataatcatcactgcctatactttcactagttgacaccaacgaaaagacaaggtgttaatcatgacactttccttaagtgttaaacacaagcaaaccagaatagcaagtttcaaatatttagaattctttccaagctaagcaaaacattctttagcagtgaccacaccacccgccaagttctaaaactagctgtttcaacttggaaaattatatctaccttaaaagttcttatatgtaattaaaagttcttattaaaataataagcagaaaaaaaacctgtcacctaaaagttcattttgatatatcttataccctcttacactagggaggaagggagaacttcgacttaaaaaatgcaatgtccacctagatgacgtcaatacatatacacgtttgaactgcttttcacatcagcgttaagaaatttgggggcaacacaaagatctgggcatttgtcacaggatccaactacaactagacccggtcgttgtcaatctatgatctttggcacctctggatctctagaataaaacttggtccccaagttcttgtgggcccaccctcggcagtcagccctacggcggggcgggagcggccccaccctagctccaggcgatactcacaaacttggggcgcttctccccaggctcctcggggccactgggcggcggagggtgttgggggcccttcctgcgcggcatcttgctttcccggcagccgcggagagaggctgaggaagggtagggagtcccagcggctgagccttgggccgggtggtgcagccgcggctggtgccgttccatctttccccgcagctccggggaccggaaagaaggtggccactcagcaagccgcaagctggaagctgagggatcgacaacaggttttactcccggggtccgccacccaaacagtcagcacagcctagcccaaccgctgaagtcggggccgcagccaacacatctgaaaactcccgccacccgtgttggcccgggactggccaatcccgcgccgccggatca

SEQ ID NO: 586 - DNA, 498397 bp, Homo sapiens; identical to SEQ ID NO: 585

SEQ ID NO: 587 - DNA, 498397 bp, Homo sapiens; identical to SEQ ID NO: 585

SEQ ID NO: 588 - DNA, 498397 bp, Homo sapiens; identical to SEQ ID NO: 585

SEQ ID NO: 589 - DNA, 239047 bp, Homo sapiens
tgcaatttataaatacggtttattaccatggttacaaactttcagaacaggcctctgagacattggactgagactctgccgaacatctgttaaaaaaaaaaataaaataaacttaatatagaggtctgggcatctcaagaaggaaaacagtattagacatacttttttccaaggttatgtatttctggcagcaaagtaatgcttcaatatcctgaaatacttgaagcagtaatgttatgacttttacttcccatttaattatgctactgtaaactccactgggataaggtacatatggttctttagatgagacttgtcacactaattaggattttctaggttcagtgcattgatttgttaatgtgctactgacatcggccaactggaatgcatatctctctgacatttgtctgtgcaagggattaagcaaacttatgaaacttctgaacagttgttgcccacggcactgcattcttgacacacaacttcaaaagaatgagaaaaacaggattctttctctgtgatagctccctagaaagtaacatgaaacaagtatagggttcaccttttggcatcggtgtcctttttcttctgtcgcggaaggcagccccggactgcaaggcctccagcagattatccatcactcctgtctcatcaccctctgtgaaaagagatgcagggaattccatcagccctcagggttaccatagcaatgtcaaagcatatacaaaaactggtgatggtgatggtagggagaaaaaagatcagatgccaggactaagctagcaatttcaaaataggacaggactttaactctctcattaaatcaactatcttttaatgaaaactgcctcattagtgcctatgttactgtgcactaaagggaccgagttccacggattcacttcagagcactgcttttatagtccaacagcacaattaccttaaatggaatgtggttctagtcatgtttgagtcttgagttataaatcacatttcctttgtagagatgagctattttcaaggcatcatcttctattctaaagtcaaccaggtatgggagagagtagtttttgttttttgttttttgttttttttgagacagaatctcgctctgtcgcccaggctggagtgcagtggtgagatctctactcactgcaagccctgccttccaggtttacgccatcctcctgcctcagcctcccgggtagctgggactacaggcgcctgccaccacgcccggctaattttttgtatttttagtagagatgggctttcaccatattagccagaacggtctccatctcctgacctcatgatctgcccgcctcagactaccaaagtgttgggattacaggcgtgagccactgcacacggcccgggagagtgtttttgttgttactgagattctgctgtctaaacttagcagacaaattatatttccatgctaacttttaaatataacagattatatttccatgcttccaacaattgatttttcatatcagaagataatcatcccctgacttgaggtgacacagaacaatcactacaaaattttacagaacgtatagtttatcttctataatgagaaataaatcaaaagaggctctctgaaatcaaaaggactgcactccattaagattactttaaattgatatcctgtatataattaaggaaatacgtggatatagagccaattatctctacaaagaacagattatgcctgtaatacttataagtatttatagttatcaatgttaaatattgttcaaagagaacaggagaaaaagcttcaaaggaactactggcccaaaccaaattcaagaaaaccgtaaggactttttgcccgtccagacaaggtaacttgcaggcattctttatgaaattgtatggctggtatactgctacatttaaaataatggaaagctattttccttcgaacttttattttttcctttttgatacacaatccctttacagagataagatgaaaagtgaatgcagtagaatacaaataacatactcatttacagtttataaacagatatataaatataaatatgtatcagccccttttccatctgctgctatttcatatttttagaagagtactaaaccttgtaggtgttatcaaaaaaggtgggtgagaaatagaatatttggaagttgtgaatttacaataaatgtaattctaagtgatttgatggctattttaactaaaatacattaaatatttcagacaaatagctatttgaaaatttattttcaaattcaactatatttttccttaaaaaactgcaggtaatgtcaaatatttaagatagtaaaagaaaaagaaaacatttcaaaatctaaaattacaattttaaatctttttcaagcagtcatgagattgaaaaaaaatcctagtactgaaatcaaatagaaacaaataaacatgttttcatattgatagattataaaggagggggaaaaaagaatccaagtaacttttgaatactttaatggcataaagtttaagggaaaaaaactataaagaaaatgtgaactttcttcttagtaaatttattgttggtagtggtattgatgtagtgattctcagactattgtgtgtgtataaaagctggagcagatgtgtaaatgtgccgatgtgctcactgtgggaaagaaaatggaaatatggaattggagaaaaagaaaaagaaccaagaagggttggattggatgtataggtattaatgtaagctcaaggcttaacaaaacaaaacaaacaaacaaacaaacaaaaaaacccttttcctataacactatagtagcatcaatgagcatttggatcttggtttctagctaccgttactagtcctaaaatcttcgtttctaatgacctctctcgccctcagatcttggtttctacataccattactccctaaaaggaatgacaatgcttacagaaatggctgattctagaactgaggccaagaaagtgtgaaatgagtcagaaacatattgttgtgccagaaaataagaaagtgctcaaaaatagatagtgatatgttgaaaagacaaagaagccagattgaaacattgccttggccaaatttaggacaactgagtatcaaataaataatcatgggaatgggattattgcacactgaggaaaaaagaatcatgcatccatagtgatactaaaaaatacatagtaataaaaatgtaggaaggagagttcctctttaaagaacagtgtcaactaatagatgtcaaagatatgagggaactacaaaattcaccacattacaattcacatagtaagaaatgattcaggcaggagtcatcaacggttgcaaaaactattgtgcataagggatgtagaggaacaggatatagagaaatctggtagataccaccttatccaaataatcaaatttgacattaccaacaatgtggaatatgctgatatcaattgcctcctgaagtgatgcacaacttaacctgtgtagcacttcgcacaaaaatatttaacttgaatctgaatgcaaggcaacaatcatagaagtccaaagtaagggacattctgtgacacaactggcctaggatctaaaaatgtatcaatatcatgaaagataaagagaggaagaaatagagaaagagagaagaaaaggctagagaactgttctagattaaaagagactaaagaggaacgacaatgaagtatagaggagtccctgattaacccctgaattgaaagaagttatatatgacgttattgggataactggagaaatttgaatatggactgggtatcagataattacattgtaccaatgttaagttatcagagtgtgataactgtattatggttcactagaataatctcattgttcttaggcaataaatgctgacagttttaggctcacaaaacaacttacacagtctcatgtttattacttcatgcctttgaacatgctattatatctacacagaacatctgtctcactttcttcaccaagctagctcttacccttccttcaaaacggagaactgagaatcctttcctgacccatgtggcataaactaggtgcccctctgtgtcccagtggtctgtaatacatataccaataaattctttacaatgttatattgtttatgtgactctttctaccactaaaccacgagcccactgagggcagggattatagatttcatttatcttcaacacctggcaaaatgcgactattatatagagagtgttcaataaatatatgctggctaaattagctaaatatatgttgactaaattagctaaatatatgttgactaaattagctaagatggtcagctggaagggttgattatgcatgagaataaagctcatagatggacaggggtccagggaagagatgggaatacattcccgccaccattctaaacaacacagctttctttcttccttttcccttgtctcatacatctatttagttgtcaaatactatagactgaaactccccattatctcctgaactaatctgctgttccttttctaactacactttatgttggtattacagaactgaattattttttatctggaatactgcatgagttgcctagtcacattgcttccagtttctccctaattctgcccatgcattactgataagtaagtcctacagcagaaatgatcttcagttcccccggtcacaaagtttcaatatatctcagttcttacaatataaagttccaactctttttttcatttttatttttaattttcttttttttgctcaaatggattttgacagataaagtccaaactcttattcctaccccaacaatgatttcaattgtatttccaattgtatctcttacttccaaccatcccaacctgttctttagctaaaggcaactgcctgtgattctctacaaacattctttctctcgtccatcactgtccacctggaacctctacccctgctctcatcctccagagcagatggctatttttggccttcactctcacatgcataatgggaagaatacaataatgaagtaaaacaacttgcattctagtctgagctttcaactaactacctgtgagacactagactattatatacataatcattcctgacatatgcaatacagacaatacctgtctagggttaatgagggaatcaaatgagataatacaaatgaaagcacttgataaattgctaagtgatatacaaatatagggaaagaaattcacagataaaatccatggtaaattacaggacatgtatgaaatgcctgcttattattaaatgtttcaagcactgttttagatatgttacaaatgaaggaagtctttttctttttttttttttgagatggagtcttgctctgtcgcccagactggagtgcagtggcatgatctcagctcacagcaacctctgcctcccgggtccaagcgattctcctgtctcagcctcccaagtagctgggattacaggcgtgccccaccatgcccacctaatttttgcatttttactagagacagggtttcaccatgttggccaggctggtctcgaactcctgacctcaggttatctgccagcctaggcttcccaaagtgctgggattacaggcatgagagtcaccgcgcacggccgagggaagtcttttatagtgtattctattacgctcttcattaggtataacatcatttctaagaaaaactctgacttgaagtacaaatagactcttgaaataaaccaaagtgtaagatggggacatataaagaagatgttcttccaaatgttaaaaatgcatttagaacattcaaccaacacatgttcacctggcatatggtacggtgtgccaggatgttactaggcactaaagatacctaagacccatgcatatggtactgtgtgccaggatgttactaggcaccaagatacctaagacccatgcatatggtactgtgtgccaggatgttactaggcaccaagatacctaggccccaaaggtaaacacaaaagcatttctgctctcacaagcagaaaagtgtatatatgagttactggagatgtacagcttcctagtgaatgatgactcgaagaataagcaggagttactcatgttagggactgtagagggaatagcattcttggcaaaaggaataacaggtacgaaggcaaaaagtatgaataaaaacaaaaaatgaggtgtaataagatgtttagatgatttatatttacagtattctaacatagaccagagaagttaaaattagtcagtttttcttagagtagaattcaatttctccagctataatttatattaaaaatatttatagtttctcccctgctgtgaaaactcttaaataactagactaactgcaaaagtcaaagatttcctatatgtgaaaaacatatcatcttaatttgtaaatggtattttaaaaaattgcactgtgtcaaaggaaatggagaagggagagttaaggacatttctaaagtggaatcaataggtcttaggaaccgaaagaaggcggaactgctaaggacatgtctgagatctctgcggcccattgctggagaaaagaaaatatgaaatttaaatattattgattttgatggggaacaaagattggaaaatataatgagtttccttttggacatgttaatggaaggtgctagcagggacctccagtaacttctggaagacagctggaaattcgggcctcaaattcagacaaaaatgtgggtaatatttttggaagtcatttccatattgtaaaaaatactcattcagcactctggaaaagtatatgcctgaatcagaagaggtggcatcttggaaaccacctaagtttaaaggacaggagaaaaaagataagtcagtgatccagtaggaactctctttccttattccattttcttcagccacggtacaacctgaaattttaaataactaagcatacaaagaagatcctaaaaggttctagaatgctgcaagcaagtaaacaaatgaaaacaggtcaaatatgtaggaaggaaataagactaggactggatttctcagtggcaacactgaattccaaaagataggcaagaaatggtttccaaattctgaagcgaaattatttccagtgaagaaatgattatgttgctaatcagacaaggatagaaaatggacatttttcaaacatgcaagtgtctatacatgccatcttagaaagagactgcaagatgtgcttttgcaaaaccaaaacaagaggggtagaatagtaagaaagaggaaaacatggcatccagaaaaggagaagggacaagagagcaaagtggcaaaaggaattcccaggatgtcccagtctcagagcagccagtttagatcacatggatcacatgggaggaaactgggcagtgggacagagtagtggccacagaaccggtagcaaatctattgtgtcggaccatttgcaaaatgattgctgattatttcccagatccattgaagactttggataatacagtaacaggtatgtatgtacaaatactaaacaaactttttgagaagtctctattaatctagaaacaacaagattgtcccataggaaatgctgtagtctgaatgttagacttgatctccaatgtaatggtattaaaaggtagggtctttatgaggtgattaggtcaggagggcagaaatctcatgaatgggattagtggccttataaaagaggttcaaggaagctgttagtcccttccaccacatgaggacacagcagcaagacaccatatatggagcagacagtgaaccatcaccaggcataaaatttgctggcatcatgatcttgtatttcccagccttcagaactgcaagaaataaatttctgttgtttataaattacccagtctaaggtgtttttgttatagcagcaggaaaaaaccaggacagaaacaaggaatactgaaatttggggtaaagaaaaaaaaacttaaaaattaaaagaagaaaaataaagaaaacaaagtatatttacatagtgccaatattataaacactggccattctgttggccatcaactgtgatataattataatgaaagacaatggggtaaaggaagaggggtaatccacacaaggtggattagtggtgagagggcattagggaactaaatcaggaactcagtaatgtctaaaataaaaaattgatatgcaacagtctatgctattatctagaaataaggaacacataaatatcagaagaaatatctaagaattaaaagtgattgcctctgggaagtgggaggaggttgagaggagtgagggagaagatattttatcatgctatgagcctattatatttaatttaggaatttgtagacattgataaatacaagatagttaaaaattttattgaaagagaaagaagatggctgaggaagagaatttgaaggaagaggttgattcttgacctaaagatgcttacctctgagaaggggaggaagacaggtaaaaatcgtaaaacacaacaggttgaatattatgacagagatattcagaatgtggtacagggtggtgggcatgtagtatggggcagagggagaaggaacagcagttacagaaggctcagaatatctgagacttaaagaaccgatttaagagtgccagagctgtcaaaagagacaagacccagctaaagctgtcaggaaagctgtacaaggcagggattcttgaagaatgtgcagtggatatgagtaggaagagataacaggggtaacgctgcgaggtgaaggtgaagagagagccggggccaactcaccaagggctgaatataccatgctatggagtttagactttaaaggagccatgaagtcattttaagctaggaagtaacatggtcaaatttctactttagaaagaatattttgagaagagaaaagactaaaggcaaaaaacaaacaaacaaaaaacaaacccaagaggcatgtttaatgatttaaatctagacaaaatgtgatttcagggcccaagtaagttacagaagtggtgaaaatagaaaaaagaaaggaggagacatagagaaatcttggtatccgtggttgtgaatattataaagaaatagttaaggctgatttccaggcatttggctcagccaattgtatatatattgatatcatttgccaagtacagaaccgtctttgtttgatgatagaatgagttggatctagacaggagctcaattttggatatgttaagttgaaatgttcatgagatatacaaatacaaagtgattcaaggcttctagagggctgatagagtcacaggtttaaaacttgggaaagaggaattggttacactaatacattcaacttagaagcataggtcgtacctgaaactatggaaaagagtacaagcatagtaaagtggtagagaacacaagttctgaattcatccatttagattcaaaccaatggctccccaactaacaatcagtgttattgggcatattacttagtctctaaaaccctcatttattccccctaaacgttgaaagggcaagaagaacagcacctatttcacaaaatattgagaggattaaaacagataaatcacgtacaatgctcagtagggtgcctggctcatattaagagcttactaacagtgaatctttgttattttgcttattgatattatggtagagcttgagctctcttagggagacattgtgtagtgacaagaaaagagagctgagggtaatgcacaaggcaaactaataggaaaaggtgcttttaagaggaaatgactattatcaacctgtgaccattttccattgtgtttactttgtgtgtgcttttatagctccttcttttactttccactgtctcctgacatactttcctaaagtcaaacaactatatattactattatttatttatttatttagaggcgaagtcttgctctgtcgcccaggctggagtgcagtggcgcgatctcggctcactacaaactccgcctcccaggttcaagtgattctcctgtctcaacctcctgagtagctgggactacaggtgcacgccaccacaccagctaattttttgtatttttagtagagacagggtttcaccatattagctaggatggtctcaatctcctgacctcgtgatccacccgctttggcctcccaaagtgctgggattacaggtgtgagccactatgcccagcctatattattattattttttgaagacagctctgtcacccaggctggagtgaagtggtgtaatctcagctcatggcaacctctgcctcccaggttcaagtgattctcatgcttcagccttcagagtagctgggattataggcatgtgccacaatgcctgactaattttttgtatttttagtagagatggggtttcaccacgttgcccaggctggtcttgaactcctgagctcaggcaatctgcctgcttcggcctcccaaagtgttgggattacaggtgtgagccaccacgcccagtgacattttctaatatttcagtagtagtaagtgacgtgaagattacaatctggaatttggaatgggactagggaaggaaagcacagtttccccaaaggttgaaagtgtgcagttgatatacaaaattcataggcttatagtttaacccaattctagaagaaaaaccacacacgcgcgcacacacacacacacacacagttgccctaacataattacatgaattattcctctatgattctggttatagagatttttgggaaaaagattatacagcttctcttggtaacccagttcagtctttaactagctagaacaaagctcaaaatgctacttaaaccagacagcaaaaagacaggaataacttcaaacaaagtctttgaacttgtcttaatccagatgtgaaactgaaaatttatttgagtcaagggagttagaaagccgattttcattgggatttaactgataaaatgataatcagaacagttctctttcatactgtaattaagtgactggctcaaccacaagaagtggaattttatggggaaaaaactccaataggttaatatttctgtttttttctcccttattcgtcatgatttgtacaaatttcattaaatatatttctgttacaagttaggagaaaaaattagaatattttacaagaaaggaagttttatttattttttccttaaaatagagcacccaagagcaaagttaaagagtgaaactcctggacttgaatcttgcttcttactcttatcagctgtgtgctccttaaagaccacccctgtctccttgtgcctcctcatacctataagatgaggataataatagtatttatcctcaaagactattgtgaagattaagcaaggtataaagagcttagcacagtgccccccatatgtaaggcttaaaaaatattagctattcatatttttaatattttgatgactattcttgttcactaatatagcaaatattgctgattagtcaatgcaacacattcattctctaccttctccttccttccacagaggctaggaaagctaaaatttctctctgtggctcccctgcagctaagctagaagtggccgtgtgatgcatttctgtctaataaggcatatatgtacataaagtatggtatttctagacataaaagatgtatatgttgataaccactcttcctcttcctatcttaaatatggcctggaattacggcagctatgactgctatcatatgttaccacctccttcttcctatcttgaataggcctggatctgtagcatccatcttatacttaggagtacagaccacaaggtcattcttttagttgctctggataaaacatacggcttgctggagcccaggaggcagaggttgcagtgagctgagatcacgcctcagcactatagcctgggtgacatagcaagaccctgtctcaaaaaaatcccatgaccaacaacaaaaaataaggctacattttcaaagtttaagtgaaaaatattttgcagctacattagaatgtgtaaaccataattagcatacaatttattacattgtatccaaatttgaatctaaataatttcatgtcttacactaaataggattatagagatgatatttatgaaataaaggattattattctacaaactctccagcttaaaaaaagaaacctattcttggatgtcatgaataaactatgattgaattttaactatatacacaaccaggaaaaatggtaatataaatatactataacaaattgtatcatattgttattaattcttaattttcacatttcttatgatttaggttctgttgtaagaaaataattccggataaaaaagctatttatctgctcacttaattgtctactcaaataaaaaagttacaatcatttttggaatataaacatattaaggcacaagatgtaagagtaaccatataatggatgaatttgtcattacaaaaataaggagatatatcacatttaaaaagaaaaaaaacttcagtacataagacagcatttcctaaagtgtgcaccacagaacactagtcctataagaagctctgtgtgtatgtgtttagggagagggggtagagaaggtggctctgtggtcaaataagtttggataataatgagcaacagaggctgggtgttgtggcttacgcctgtaatcccagcaacttgggagactgaggcaggaggatcacttgaacccaagagttcaagactagcctgggcaacatagtgagaccttgtctcttaaaaaaaaaatagccagtatggtggtgcatgcctgtagtcccagctactcaaggggtgacgtggggggatcactcgagcccaggaagttgaggctgcagtgacccgtagctgagccactgcactgcagcctgggtgacaaagtgagaccttgtctcaataacaataataataatgtgtaacatgtactacacttggtgattcatatcaaatacacatgacaagtcaattcatgataaaggtggcatttcaaatcagtagaagattaaaaaaatgtgttcaataactactgtggtagcattagcctatttggatctcaccttgttatttataccaaaataaattccaagtggatcaaacatttcaacattaaaagattaaagtgtaaaactatagcagagaatatggaaaagtatattttcagtagttctggaatgggaagatattcctaagaaaatccaaaagtaatataaatatctaaaaatcaaataggacaggtacagtggctcatgcctgtaccctcaggactttgtgaggccaaggagagagaatcacttgagcctaggaatttgaaaccagcctagacaacatagtgagactttgtttctattaaaaataataaaaaatcaaataataacaaactgtacacataaacaatgaaaggataagctggaaaaaatatttgaaacattggcattccctcggtctgattttcttaaaataaagaatgcttgtaactcagtaagaaacaccaagaaatgggcaattgctattcagggaacccatcttctatgatctgaatctttgtgttcccccccaaccccaaatttatatgttgaaatcctaattccaaggtgatgatattaggagaaagggctttgggaggtgatgagatcataagggcagagcctttgttaatgagattagtgcttttataaaagggattctagagagctgcctttgtcccttccacaatgtgaggacacagctagaaggttacaggccctcagtgaacactgaatctgctggcatcttgattttggattttccagcctccataactgtgataaataaacttctgttcttcataagctactcagtttatgatattttttatagcagactgaatggactaagacaccataacaaaaataaataaaccatgctttagatgtgatataatcctcaacctcattcataattaaagatattctaaatacatcaatgagagatcattttcatctaacagcatagcaacaatgaaaaattatgataaatcagtattggtgaagggttggggaagaggtcacttcacacatttgttgctgaaaaatataaaactaatgcaatcacttcggaatataatttagtaatttttattagaaataaaattgtggccatctgtggtggctcatgcctataatcctagcactttggaaggccaacgtgggtgaatcgcttgaggccaggagtttcagactagcctgggcaacacagtgagacctctcctctaaaaaatagcttttttaaaaagaaaaaagattgcacatatcacataataatttttctctgagaaaattattctacatgtataacttacatgtgtggaaaaacatgtaaaagggtgtctgttatattgttgttcattgtaacaggagactagaaacaaactaaatgtccatctacaagagattgactaaataaactatgacatccatataccagaatattttgtactgtcaaaaaatgaggcatatttaaattattgatatggaccatctccaaaatatagtaagtgaaataaaccaagtccttattttatcaatgaggacatcgaatgaagacctttctatgaccacttatggctattaactacagagccagcaatgggttttacgacttccagcagcttagcaattattccaccacatggtgctgaaaaaaggaactacttaatcatttttccagtggtaaatgattgttaaaatgtcttgcatgtaagtattcaagtaacccactctgatgagcttgttcactctgacctattctaaaattactaaagaaagcaaaatttagaaactggcattgactccctggcaaaaagaatgctaccacagtcgaccttgtgtgttatgtagggtctagggtgctgaacagatgccttcagttgcaaaagcacagaatgtcggcgggtgggggggaatgtatctatttaaatacatatgtagatgtgaagtgataatgacatttaacaaaatgtgactatcacacagagcgaacacccacgatcctttaatcacagagtaacccagggaggaaaaggttaattacatggcacagcacctccacttctgggtagaagtttcacttgtcacccacaagagcttcactttattctgagtgaagtttaacaagcttaagcttgacaaatgcttacttcgcattgaaaatatattaggatttgttttagatttgttttagtattttattagtgaagaattgacttttcaatggcttttttccttatgaagtttttgaataaagaatgaaatggtttcagataatgaaaatgcttaattcaataagaattaaaaaaagaaggggaaggagctagagaataatatcggtaatttcacaggaattttctttcaggagaagccaggataaatggacttgaggccacgaggagccagtgagtggtgcctggaacaccgtatgatgcccagaggagcccagcagtcatgctctgacagcagcatatggtgcgcactggaagaaggggaaaataaggtcaggaaggcagactgggagcttggattcgaggctgaagaactgccatcaaatgtttttgaaaggtgtgaaataatcaaaactgtactccatgatgattaaagctggcatagtgtgaaggtgtcaagcctgggtgactgggaaaatggtggtatcattaacccaaaatgagaacatgaaaatcaggttttatgtggaacacgacaagttaggttttagatgaattgattttgaggtactggcagaatattctgttttgttcaggaagtagttggaaatataaaactataaagtctattgtttaattcaattctacaaagatacactaaggactacgtgtcaggcactgaactagccccagcccttgttcccatgggacttaaatgtaagagcaagttcaacacataattaatgactacctgtatgacgaatgttacacaaaataaatcagggtgctatgaaattgcttaatactgaggcaatagaggtgaagagctatagctatggttgcctagtgatgattccaggggttattctttgatacctggatttttacttaaatttctgaagatatgttttatttgtaccttaaacacagaaccatatagatatcacagtaaactgtggaaacctgtgtattctcattttgagctttaagggttaaagcccatctcactgctgccaaccttgcacaaagtaatttttaccaggctcaagttctttgttcatttctaacataaactttgtgttcaaagtactataagtattcattacctttgtttcattttaaaggagaaatgcagatttattctgcccaaatataatgtccttccttattccttccacagtgagatgtagcatcccattagtattaaacacagaggaaattttaaaatcctattcagaataacagcaacattgttttgaaaaggaggaagtcagcaaggagaataaggcaaatctgaatgagtgaaaattggtgaagaaaaagaattgacatatgctttcagaagaaagcaagtatgagaaaaatgaaagaggagacaactgaactttcaatgaactcattaacaattgtaaaaaaactggaggcaaaaatgtgctacagtctcaagagaacaatgaaagactccctccccccgctccacaactataaaaagctgacaaaatgaatacacgagccccacagtaaaagctgatattaggtaactttgagaacaactttattttatttttatttatttatttttttgaaagagatgagtctgtctctgttgccctaggctggagagtgcagtggcacaatcatagctcgctataataatctcaaactcctgggctcaaaggatcctcctgctaaagcctcctgagtacctgagactataccatgcccaagtaattaaaaaaaattttgttttataaagacaggatctcactatattgctcaggatggtctcaaactcctggcctcatgcaatcctcccacctcagcctaccaaagtgttgggattacgggtgtgagccatcattcctggtcaagaacagttttatttaggaaacaagagatacataaaataaagaataaaaaatttaaatatgaattaagacacactaggaactatcactttgattgaatgcctatgtgctagagtctgtatggaacattttacctagattttctaatttaattctcactcccctctttcaaagtagctattatctaatccattttaaagttagggaacttggagctcaaaaaggtaaagtaaggtgcccaaagccctgccatagggtggtagcagaggggagatttgatatctttctgattctaaagctcattctttccactatagacttttattgagagaggtgttacatgaaaattgataactattcagatccttaggtttgctgacttatatttaaaggtgttttaggaaatgctttaaggcacaaagaggtagtagctttcagagcaggaaacaggagcaggcaagcacaagctcgtttccccaaattcgacgggagctttctcccagaatctgacaataagagagatgcaggtcattcacagatgctccttcctcagagagaaagaccagaaacactcctcctcctgagaccaggagtatctgaaaatattagaattacttcaatctgccatggcctcctgactcctcctttcaacctagccactggggattgctgtagttgggctaaaactttgaaggcagctaaaccaccatcaccatcattcttagacaacagtgtccttctgatctttatttcctccagcattattagcatgaacaatctctctactacctcaatttcttcaccatacactcctttcacctcgttctcttaattgaaaatgggctctacttggaaactggacagatgatctctgctcaccccttctggtagatgttgcttgttcccctcctatctcacgtgcttaaagtctgcagggcacaggtggaggacatgggaatgtctgctttctccttgatcaaagctgctatgtcaggctgtcacttttttttcctcatgtaaaaagcacccgcctttgagacacatgtcattcagttacactgctgccatccctctgggtcactgtcatctaatcacgcacaagtctaccctctcattcagaataaactgtcaattgagtcagtcttcctcatcaggccaggctctgccatcatcttgtgagaattcagtttaatgttaatatctaatccaacaccaggtcctaagagttccttgacctcctcctctccagggagcaatcccttctacttcccatcaccgacttccttggccataatcgaaatcttgtcactacccagagctgttttacttccaataacttgaattcatacaaccattttctgacccatgtccttttcctctctctcttttcctgtcatctacccatgaaaatctccaatgccctggcaccactgttttcatatccttgactatctagtttagactctgtggtgcatcactttgaccatggttcacacgctggtatcttacttccctccttcattctcctactttttcagactcccactaaaatgtaaataagccccaaactccatcttcttggcattactccagatgctgagtagtgccggtaagaaacaataccacaggatctgaactagtacatatgtgcaactgctacctcaattggattcttaatgctattcagcactcctctgtgtttcatcaggaggctctcccactccctgagagggtttacatgcttacacacttcactcaagcctcccaaccaaccatggcccttcctctgcaaaggccttccttttagatagaaaacaggaaccacttgatgaaagcttccttaacttcccaccatcaaacctacaaatgtatctgcacttaggcccaacatttcctcctttcaatctatcacaatggcagagcatgtggatttccaagacaatttcctctacctgtgctagtatcttgttgttctccacccctcctgccgccctcagaagtttactccattgattgtcattctcttccaattgccctcctttctcattcctcccagtctgcatttaaacaaattaaaacacctgctttgtcctcccctttgacttctaaatcccctgtagttactaccctttcttactcatatctcagtctcatctcccatattcattcattaactctttacgctattctttgagctaaagtcaatgggatggctgttagttcattacatgattctttagcagtatttgattgtgttgactacccattcctttttgaaatggtctcttccttgggcttcatgataccagactttcttggtcttcctactactttcatgtgactcccttgtcaaggtcctcttctgggatcttcttactctgctcattcttacaccattccttgaattttccattggtgttttattcattccatggcttcatttactgaaaactcccaagtttttatcaccagcaacaagcgctattcctgagttccaactagggtgaccaaccatcctgacttgcaagactaaggggtttcctggaacacaggactttcagtgataaaactgggagaattaggcaatctgggatgtgttggtcatactagccccttcctactcactagacatggtaacctggatgtcctagagatacctcaaatataatacagactgttcccaacttacaattttttgactttacaatcaagcaaagcaatacacattcaacagaaactgtacttgactacccatacaaccattgtctgtattcaataaattacatgagatattcaatacttgattacaaaataggttctgtgttatatgattttgcccagctgtaggctactataagtgttctggaatgttttaggtaggctaggctaagctatgatgtttggtaggtttaggtatattaaatgcagctttgacttaaaatatttccaaattatgatgggtttatctggacataaccccatcaaaagttgaggtgcatctgtatatacaaacttgaattaccattttccccaaacctctacctcttattgtgtcccttatctcagtgaatggcaccacctactcatgtcaaaacactatgagtcctttttaacaactgttgaaggtaaatataatagaaggatttctgtatccctaagcactgagtttccagttacatttcctattaggggaatattcaataggattcttatatagcctgtcagcaatttcaaatcttctttagtgaaaaaaaaaaaattaaaaaatgtatcattcatttgaaaagttacagatctgttggatagtgccagtggtgcaagatttttttcttcaatgccacatccttctactgtccaagttctgatgcgaattttgatcactatctaatccactataaatatcatttatttatttatttttatcgaggcagggtctcattgtgtggcccagactggtctcaaactcctggcctcaagagatcctcccacctcagcctcccaaagtgctgggattacaggaaccagctaccatgcccagcctagtataaatattcttctttaaacattttggaatatttctaacatgctgtttaggaatgattaattttccttcccaataagctgaaagaaagacatgttcctcaagcaatgaaactctggaaaacaatttgtattaacttgtgaatgcctcagtctgcaagacatagtacatgctttgtaggtcattaggaaacaaaatggttgtctttcatagttcattctgtaaatggcctgtgggccgcagttagctccacacatctcctcactctgtgtgggctccatcaaatattgcctttaaatttgcctggacaactgcacaaaggagaatgaacgaaagcttcagattaagaatgtacgagaagcacaagacgcaagactcttcaggccaaaggaagtaagacaaaaaagtgacttcatggtgctctgggttattatatttatatttcttcatcttcattcagcatgagacagtagataggctgataatataatgaaaaattaagactaaatttcaggaagaactatctgaaaagaaatcattattactatagggcctggccaccaaggaaaatggcatcctttcccttctcttgaatttaaggagatgcttctgtcccagggaatttaggtatatcattctctctctctttttttttttttttttgagatggagtctcgctctcccgcccaggctggagtgcagtggcgtgatctcagctcactgcgagctccgcctccgggttcacaccattctcctgcctcagcctcctgagtagctgggactacaggtggccgccaccattccaggctatttttttttatttttaatagacacagggtttcactgtgcgtgctaagatggtctcgatctcctgacctcgtgatccacctgcctcagcctcccaaagtgctgggattacaggcgtgaaacactgcgcctggccaggtatgtcattcttgaactgggtggcttgctatggtttcacaacttaaagtttgttactagacaaacagttacagacatattctccattgctcaatgtatttttctaagctcatgcttaccatttccacccgcttgccagccatcttgtgaccacatttgtacatattagtgctttcatcagggggtaagtgcatcaataagaggagaagttgaaattagattagttaatttgctacttcattaacagctgtggtaaaaagtccaaggagaaaaaagattgaaactagctaaaatgaggggtttgtattgtaagtgaatctaaattatctatgtcccctattcctgcggataactgagagtcagctgtgcacacatctgtgggtgtttataaacatttaccatctgtgagaagcttatggggcgtaaatggtgggctaattagtgaaatgctagtcatttctaatgacagttgttatggataaagattttatccaggttaaattgatctcagaacctcgatcacgggaggccactctaccttttatgacaagactaagtagttacactatgctgaacatgtcacacattaaggatgcaccataactagattagactgctagtttatgcatgttaatgagctctgttcttaatagactgaagtgtggattgagtatttgtcagggaaaatgagaagttgtcagtctgttgaaaggtcaaccatttctatagtaagacattttcatttctgttctacaaatatattaagtaccttccattcagaaaattaagagcatagacagaaaactatgagattcataaatgaaaagagttgtccatatacatacacacatatgtgcatacagatatatttccctaacttcaccatatcagtaactttttctaaacatatcttttactgatccatattgtgggcaaacattctaaacaggtaattttaaactaaattcatcctataaccaaaggggggaaaaaaaccatactgtataagaagagagtcatatttactgtgtaataaaaagtatcttaaagtagagattatgttgtaaaagaggacagtgtcatagaacaagtgagtggaagagtaggcaaaacttcattccttgggttctaataaagtttgttattaatttacagaatacaaatggaattttccaaattagaaggaatcttattgtgtagataaggagaattatggtctgaagctaactggcctgctattacttagctactggtggagcagggactggaatactgataacccaactcctaaaccttagcaccaaacatttcatgacaccactattaacagagaatagcaatattgtatataatgtcaatagttttagtaaatgaaaaaaaaacaccctatgtaaaatgtcactccttcccacactttctatccccccatccctactttattttgttctccttataagttgtggacttctaatgctgtttatttatcttaaatgttgtctgtctcctgccagaatatatgcccatgagggccgggacactcgcttgttttattttctgctgtacccctagtgcctaggatagtatcatgacataatatgcgataaataaatatttgctgaaagaaagttttgatagaaatactttttttcaccatcacactaataattctgctaatgaaggaagtatttcaatgcccatttttataatttcttttgtcagaaatttaatggtcacaaaagcaaatcacacaggagccttgggaatgtctttcagaatgttagataaggtgtaattagtacctaatgaaaaaacaataaccaaatactgactacaacaatatcacctgccagcaaaataaacgaatgcagacttcaataatgagaatcctagagccttggaactgaatgtttgggctagttttagatgaagaggaaggagtgggactgacctgttttccttcaaggggataatgggacacattctctccattgccctacctgaaccccatgcctcagattctccaggaaagggccacctccagcttatcctcatgagctaaacatggtttattttcagaggttctcggttaatctagctacaaaaacttgcaaagttgtctttattaacaaatttgtttttattttcctctatgaaagaagttaatagttactgtgcagatgttgtgtttcttaccctatgccaggcccattcaggtaaaaaacactcccaagattaaaaagcctttaaattggagatgtaaaatctatgtgttctaaagctggtaggagcagcatcacctacctgttcatgaagtattctccctgtctccccacacccaatccactagaaagccccattgattctgcctctaaactgcctttcaaatccatcctgtcttctcttttcagtgcatcctagttcaggtcttctacatttatctcttgcaaaattgcaagtgtcctaattagtctcattcctcctagtcccaacaccctctgatccatctgcgtttttgctacagagccatttctctaaaagcaaatcatatcactgctctgtttaatgcccttgaaatgtgcctacaaaataaagcaaaaaaaaaattcaaagcatagcatggtttcttgacttccaatttagcatcatttctgcccatagttctacccaaagatcaatcaggcctgctacattactggttagtccatatataaatgtcacacctctgtatctgaatttacttagcccattggatgcccaggcacagaaactctggcccttcatttcactgtgttcatttggtatccacctaattcaagattccacatttcaaaggaacaacaaaggtagtcttttccacatttactgctcagatgtcaatccatcctcctctctcccaccccaatgtgagagccaaaggatcattcttagtacaggaaccacccatgtagcagaaaatgcacaccacattcttaggctctgaacagaaaagatgcccccatctggtggaagagaaattggaagtgagattacatgcagtgcagtagccctgcgcattcatcccaggaggaagtggcgcatattgggtagactttcctaggaagttacagagagttgagtccaagagtggaggtgtcttgtgtccaacatgcagaattgttgagaatgggctaaggaaacaagattagggtacaagaaggctgcagaagcaccacaagaagctgagtgctgtggttgaagcacagtaatttcctatgcatcctgcctggggaagaaaaaaaaagttcactaagaaagagcacgagtgcaagagaagaatgtttccaagaatcattaacataaggaagccaaggagggaactaagagaaatccaattgttctatttggttaccattcaaaggcaaaccagtgatcacctttaccacaagcagacaggaggaatgatgccaaagcagggaggctgttatggacgtagatgccaactgaaccagaaagagggcatatgcacagaagggtggccgaagctggcttccttcatcgaaggaagaagggagataagaagagatcatggaagggaatttcaaacacaaataacaactctctactgaaattactggaaatatgcacacacacacacacacacacacacacacacacacacacacacacagaaggagaattgactacattgttaaccatcaggtaggctgatgactcagtcataaattaaactgcatttatagaaatagttatatctctgcatatctgaacttgctgtcctaactatgaaattccccgtttgttaccaaaagtataagagcacataaaacaaacttgacatatgtcatatcttgtcctaggattgtgccaatctattttatggggtctgcataaatagaacatgtacagttgaggagtttttgtcccacaaatgtgaattccataaatatttttaaagtgcttattaaacacctgctatggaaagaaattagaagcaacagctcactgtaaaagatatttttttgaacatggttaattttgattaaaggttttatttttgtaagatttattattgagaaataatggcatgtttgatctttatgaaaagcaaatttttcatagcaaaatcaaaatattaactgaagtatcatttaaaatgactatagtaaatgtttcatatcatgtccctcctttcttgtactttattaaagattaatattgagtatctaattaatgaaatgagataaacacttacttcaaaaagacttctttttgaagtttctaggaggaatacaccaaattgtcaaaacttctgtttcagaatcagctgacctcaaattggagcaggctaaaaacatgcacacaagtgcgtgtgtacacgtacacatgcatcctcccccatatagaaaccctcattactcattagttaagttgtaatatattcagatggaaaattttatctctaagcgttcctcagtttctaagaatggtaaacaccatgagatatattttccccttcttttcttacctttccctttttagaactgataaaagatgactgagttcatatcctacttatatcaaagtgcaatgctttaggaataggacagtatcaagcataaaatgggaattatctcatagggaagaggaagatgtgaaaaacaacactccttccgaagatttccccatcacatgagtgtagcaattctgaacaaagcttgacatcatttgggttcttctaatattttctgggcagagaagaacgtttctttaatttcccacaatgcctccaaatataacattaagacattttatgctcaatctcggcagatatcatgatttaggaaacagcatttcctcagactgcaatgctatttaccttaatgatagaatcaattagaatacagtataatccaaacgacatgtttcctcagaccaaattccttcagaatcccatggaacgggtctctgaaagtttgtctatgggtagtgggagcagaactagcatctttgctcaagtgtgaacggtatttccaacgatcataaacaatattttcatctaccaaagccaaaatcacagagtacaattaacagagtcacagcaaaatggtaaaataatctgttaaaatagttaatacatttattttttatctaataaaagtatcccatgcgttcaagaaataatgagtgactactatcaaaaggcactgtcctttttttgagagaagagcattagtgttccatatcaaaccataaaataaataataaaggataaaggttttaaaaaagtacttttattcacacgtgaatccagcagaaagtacaatctaattagccttgaaaacatccactgaaaatcagagatcataattgcaattcagcactaatagaatcattacttctgaaatatatctgaaatgcagcaaaaagactttttcttagttcttggcctttgaattaaaataatcttttgttccccaagcaaacaatcttcttgactttgtaacacttgaaggctactttgcagttaagttaaaaagaggaactgtcacacatttagaatcttcaaactaattgccacagaatcagtgttggaatgactttggagggaatctatccagtttcctaaagcagtgatcctttacacaacactcatgaaagctagtaatagaacctcagattcagcactaattttacaagagttcctgcctgaatagcactaatagtttaaaaataaacattcaaaggattctattgaactgaaattactgtcacttatacccattaatgataattattattggaagttctatgatggcaattcactctagtcaggcaatggtctccaagaattgcttgctctaaagacagtcagtcatctattttctgttactatgctagtctgtcatattcttcctgccttggggcattctagcctgtgttaaggctgccctcattgttaactctgttactatcatattgcttataattctcttgaaaaacattggatatctgaggaaggaagctatccaggaaacaatattttaaaatcctattacaaaataatgtctaatttcatctaaacactaatgcctatttataccatttacatgtaacatataaatattcaatttctttgcttaatttccccagtctgccctagggtatatttattcatcatcaaatgccaaatactactgagttgttttttttccccctctttgagataatcactttagactttgagcaaccttcacgaccaagttcaacaccaatgaatagatttccttcaactttaaggatttaatgtcagaatgacccaaaatacaaagaaaagagagaacctattaataaaaaaagaaaaacctggctccacctatgaccttttgacacactgatatttccatcttgaaagatatacaaacaatactatagaaatactggggtctataagctgggctaaaaggataagaagcacaatggttgtgctagatcggttgctgaaacaatcagcagcccagatgcttgctagcatttcaaaagttcaactgcatgactttccatttcaaattaatagatctaaaaatcacacaattctctgtagcaagaaatatgcctaaagattaagttttctctgacaattatcattaattttatcaatatatcaattttaattaatttacttatcaattattatttatttatcaatttataaatatatcaattttatcaaaataacaataactcattatttttcaacacagactggtcattttgcaaatgcatacttttggctataggaagacaaggaaaagttttttttttttacttcatggtttttttttaatctgtctcttaaaatcaaagaacagagtctatgacttattgatctatattattattattattattattatttttttttttttttttttttttttgagacagagtctcgctctgtcgcccaggccggactgcggactgcagtggcgcaatctcggctcactgcaagctccgcttcgcgggttcacgccattctcctgcctcagcctcccgagtagctgggactacaggcgcccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgcccagccgatctatattatgaatcagcaaaatttttctgtgaaggccagctaacaaatattttaggctttgtgggatatatggtttatgttgattagtggagacagctaaggagtattgaatgttacagacaaagaagatgcaatgctgtgattgagttctcaattataatacaataaatgtggctgacattatcaaagttacagagttttccacattgtgataagatcaaaagaactgattggtatgatttttttgccctagaatatgaacagggtgaaattatgaataagtgatgttaatataaagatttctttggtaaaattcttagaggtagaccatgctacaccttaaaaatttaaattattttgcctcaaataaagtttatgaaaattggcatttaatcttttattcccagagaagttaaacaacaaaaagtgaagttcagaatatagtaaataccatattataataatatgaaaaacattttgaaaatgattttaaaatattggatgagcaataaactaattagcatgaggatatgccacaaaaatgcttaacaagagtggcactgataaccctcaagaaagtttaaaaagaaagaaagaaaaagacaaaagaaaaaaataatcactttcaaattaagttatgttggaagtctgagaacctcctcttttctggggcttgttggaaggggacaaaggatggtgtgtgagccttgtatagctgcatggagaagacgcaaattagtgcacaaagtggttgaactctgaatgagttttcataatttaagctatgttattccagtgaaagagatgcctgcacataagtgaaaagctgcctagttaactgacagagagactcttggaaaaatttcccaccagacattgcttgctactatttatggaacagaatttcagtttcttaataccatcagaaggaaaaaattgttacatggtacagttggtggacgtggaagaatgtctcagggcacacattacaagtaaagcacacaaaatgtttgtgccactcctaaaacctactatattgcaaattctctggttccttaacttctattctgagtcaaacaatgaaagtactgaacacatttctacctccctcagaaaagttgacctctggcaactatgttgggtcagaactattcagaacattgaagaatccctcctttgactgtgacaatcgccccagaagttccaaacacaaagggaagaccacatggcttaaaaccactgattatgttaccaaagacatgactgaccctctcacacatttccagggaaaataattctcaatcttcctatataggtatagtctagtgacagttaccacaatcattttggtccctttttcctgtaccatggttaaatcatcagtggtaaaatataatagcacaatagttaaaaatatgacctcgtgagaagacttgagtactggcttcatggcttgttaaatctgtgatcatgtgcaagtaaattaaacttttcgacatataaaatagtctcatgagtttgttataagtattacatgtaataataaatataggctggcaaataatatgtgatcaataaatgccagcagtagtagtagcagttgttgttgttgttgttgttgttacaatgtctgttctataaatgatggagtaaagaaaagagaaatatatccaagccaatgcaattccatttgttctacccttctatatcgagaaattactaaaactattggcttatttatatgcaccaattgccaataacactaaaaaactgaaagcattactgcacaaaactagaatatgggcaattatggaaagtaatctaagttttatgatatctgtagaagacagggtaattgttaaagcttttatgaaagcaagtacaaacgttaattgcatatctgttgagattggcagagacattccgaagtagaatttatgtaatatgcatttcctctaaaatggaggcctaattgcttagttattctaaattgcagaatggaaaacaaaggagcagttttggccatgtgggtaaacaacagatttctaaaagctaattatctctttatttaatagactgaagttgcaccaaatgagacatttaagtctaataaataatagacaaattgtaacctaaagactaaaatataggagctgctcatacagtttttattgctccattaaataagctcttatttacttcccccacaaaacataattacacaacactgggtccatttcaaggccattttgatctgctatttaaaaatgatgtgaatcaacctacatactcaggaagtcttaaagcataatattgaattctgttagcaaatgccctatttgtgtccatgattaagaaacagaaatggaattaagaaaaagttgtgcataatcacataaaattattactactacttgccttactagaaatgattacacttaagaagagttatgcattttaaattaataaccactagggtctatgcttagtagttttcatgtcagatgaataggtactttttaaattaaaatagttcaaactcaagcatcaaccttagacatttactcaaaatttatatgttgattaaataaagacatcatgaaaatgtaacttgcttgtttatgtaataccaaaacattcaacagaaataaccaaaactgtgtatgtgaatatttaagagaccttcaggttcatcatttaaaaaaaaatgagaaaacaaaaacgaaaaacatcatgttttaacactataacatgaaaataggagactgctttcttagtttggttgctcagaaggatttttaatgcttcatttttcttcttggagaaatttagtccactatttttatctttattttcattctattaacaaaaatcacattctgaaatgatagtgatagtaaataatagtagatttggaaatagttgcctgttctcttgctgagggcaagtaatgatttactatgggtaagaaagaacaggaatttaatttactgtgctacctcagatagtgatacaagaatttctacacctgtgaaaaaattcagttcttatttgcatggagaaaatactaaagccatgaaaatatatggaaggaagctccctgtgggtttatggcagagttatgtgaagatttctctcttcctccatcatccaggggtatgtgccttacatatgaaaataagctaaaacaaaaagttcctggcccagtgaggtaacaaaacactaatgtaaattcaataattcacccttccacattcttttaaggctgagaaagtcgggctaaaaatttctacgaagatttgagcagtaccatgttctgtactaaaatataacacctgcgaagaaaaattacataaagtttcaactgatcctcacagtgtttaaaaaacacaccatattagcacatatagtacagcttataagcctggttatccaaaaaccacatacactaattatataaatcttaccaacttctgaggatttttattaaacaatatttaaactagaaagtttgatacatactaatagtctccttagttctctgagaccaaattttgttactaccaccagcctaagcagtctccatctcattatcctatcttattttagttcctgtaaattattatctgacattattttatatatttggttatttgaagcactcattagaattttaaacttcattacagcaggaacctttttattcttatttatcactgtaatctcaacatatagaaaaaaacttgatgaataaaagaacaataaaaagtggccttgctatatttcgttttttaccaataaaataataatagaaatgataacacatatttttataatagtacaatgtctttattgaagatcatatttgtcaaatatcatatgcataaaattcaatgtatcaatttaaaagtataaaaaactgatatttaacatattttcagtaattaagtgctaaattagatacactagtaacctctatttcataaaaccttcaaatgttataaaaatcatgacttgacaaaaagcatattctacatataatatggaaaaaagttgactgtattatttgtgatttttttaaaaatgaaaaaagttatcaataaataagcatgtagtaatatatttgttatatggttatatgactcacttggtaataagagttactgtaagaaatcaaatgctttgttcttctacattaataattgtgttgattttaaaggaaaactaaggaccatcatcatcatttattggggttttagaagaggtctttcactttggtgagaaaaatatgtgtttacaaatattatgaaatttgggctattatccctagattattttaaatcccacagtctgaaaaaaaaattcaaagttgacttgcaaaaatttcaaacgtttttaaaagacaaagtctcacagtagcttcttaaatcatagctgtttcagcatgttgtatcaaatgagttcgattacatctatagcaaattcatatgtatgatatagacatagcacatatctgtatttattttacagatatattactttaaacttacctattttaatatcatttatataaatctaagttactcagactatgctctgcagagggcacccctgaaaaatgttaaaatgtatgatgcatatgtacctcagcaaattacaggtttggaaagtcctattgggtgaagattttacatttacttgaggcccaccgatgttaatttgcagaccatgtttaggaagagatagtacagaaaaagtctaataaaataatccaataggtcaaataagatgagctctatgattaacgaaagatataataaaacgtttctttaaatctattgttaaaattaaaaacattcaagctttttttaaaattaagaaaagaaggtaatgtcatcaacataaaattacctattttaaagaaacataaaccagctattaaacacaattgatggctaaatattagaatgcttttggtaaaatttagaaacagatccttttatattaaaacctatatatcaaatatatgattaagggaagattataaataagtagagtacagtcatattataaataatcaaaactagaaaagaaatgaagttgatatgaaatcagtgaaaggatgattttctaaacttaaaggtgacagaaaaaaatcacaaaggcaaatattaaaacatcatagaatgaaaataaaagttttatatatatcaagatatagaaataaaaaagccacattagaaggaggtatttaaaatgtaaatatgaatacatactgagctaacttgtacaaatcaataagaaaaagataacaattcacaacagaggaactaaaaatgaacttataaacgctttttaaaagtccaactttagtaatactcaaagaaatgcaaattaagataataaaacataattttaaaatctataaaattagcaaaaatcttaaaaaataagaatattcaaccaaggcacaatcataacccaatgttgaaagttgagaaaattaaagttatgcttctgaaaatcagtttgtaagtatgcatcaaaagtcttaaaaatatccttttctattccatgtccaataaaataattacaaacattttctatttatggacaaaaagattaatcacattgaaaagtcagcaataactattgttccatgacttcattactgactaatgcaagttaaattgtatatggcacaaccagtggaatcaatcatatatatattaaaaattataagaattacaagctatgaataacatgaaacattcaaaagttcagcaacataaagtgagacactgaattgcatatttactaggatcatagctactattagaaggcagaaaaatttaaaactgaaagaacagtgtgcagaaatgtttacagtgattttttggataggaagattatgggtaacagccttttgatctactattttttaggtgttttcgataatgtaaataaatttgagaaataaacttattcttaaaagtgaaagcttccttagggagacataaatttaaattaaaacatcactgacattacattggaagttttattagaatttctttgccctatcaagtttcaatctttcaaattggtataagagagaattactgagacactctgtgtgatcagaccctgggcaaaacccacaaacaatacatccaatctgccatctagcaactcatctagataactatagacaacgctaaaagagctaatgttcaggctgggagcagtggctcacgcctgtaatcccagcactttgggaggctgaggtgggtgggtcacctgaggtcaggagttaaagaccagcctggccaacacggcgaaactcggtctctactaaaaatacaaaattagccgggcatggtggcgggcccctgtaatcccagccactcgggaggcttgaggcaggagaatccctcgaacccaggaggcagaagttgcagtgagccgagatcgcgccattgcactccagcctgggcaagaagagcgaaactccatctcaaaaaaaaaaaaaaaagctaatgttcaaacaccagaatcttctgtaaattaggaagtaatatattaatttaaaattctttccagaagcatattttaaaaataaatactaaatctttctgatctccatttttattcatacttaaaaataattctgagaatattccctgaatttcaaatataaacaagaaattgtgcttagatgatttttcttcccaggaagaaacaagtgcaatacattaaggtactcgtttcgctttagtaagcataaaaatatacctgtaaagtgaaagtaaagaaggcaaagtaggcatctctgtctattcctggggaaaccttaggtgaatttgcaaccctgaattgtaaactatggtgatttagcagtgaagcggatggattttaattaaagccttgttcaatccttactgacttggaagtagaaaagccaaatttttcagggaatgaaaatataactatattttacataattcttttgcttctaaataagtggtatcttttagcttcttgaaatacatatatacatatgtttctgtaaaatttcagtaccagtctctaaaagatactttgaaacatattgacaacaattttgtcatgtttacaagaaaaaaaaaagtatccaaaatgttcagactgcttttttctttttgttgtttttttgaaacaaaatctcactctgtctcccaggctggagtgcagtgtcaagatcaaggcatactgcagcctcaaccttccaggctcaggcgatcctcccacctcaacctcccgagtagctgggaccacagattggaatacacataaattccatacattacaattggctgatatgtcgcttaagtctctttcttttaaacaatgtttatcctccatcactttttttccctcccttgggatattttgttgaagaaaccgggttacatgtcctatagaattttccacagtccatttctgacagttactttattaactgacatacattattaaagattgattattgaggtagtaattaaagaaacgtgaatacgctggaacgaaaacagcataacagaggaccaaatcacctatgaccaacactggaatgaagacactacactactcgttagtaaatggaagggaaagaagaccataaagaaagaattgttctatggtttaattacagaaacaagtggttgtattttcctttttcactaagttcattaatatactaataaagcagcccatataaatcttaagtatacatagaataaataacaaatttgatagtactcaccagtcttcatttctaataaacgctttttcttttgttggcgttcgagtctttctcgctctgctaattctttagctattctgacacgtttttctttttcctctgcttctctttttttgatattctcctttattgcttgctaaaaaaattttgaaaaatgatcaattttaaccagtgattcatcccgcaaaatggaaagttatctatttgaaaatatgcttaaggtagaaacatgattatcttttagataatggtgagttatgttagtaatacagtcttctaaaaggtatgcacagaaacccttgttaactatgttatgtatctataaatacgactgttattaaacttaaacctgcatctttaaaacatccacatcttgatggaattaactacctaaaagggagatgggagacagaaactgaaaataaaaaaaaaactaattcacaaatcaaaactgttttctcatatacatttccaaaagtgtctagcaactgaattagggttttccacatcttctttgcaaagcaaattatcaagtacaagaaaaattatcaaattaaagacataataaaagaagtgaaatcttgtagtggctactttttattacaatcatatatgaatttttctaatatagagagaaatgtcgtaaaggtaactaaagaaatatttcttggccgggcacagtggctcacgcctgtaatcccagcactttgggaggccgaggtgggcggatcataaggtcagtagatcgagaccatcctggctaacgtggtgcaactctgtctctactaaaaatacaaaaattagctgggtgtggtggcgggtgcctgtaatcccagctactagggaggctgaggcaggagaatggtgtgaacccaggaggcagagcttgcagtgagccgagatcgcaccactgcactccagcctgggcgacagagcaagactctgtctcaaaaaaaaaaaaaaaaaaaaagaaatgtttgtcatttcaaagccaggtcctctggctttgatcaaaactaataataacatgctaatcataagaagatctcaatagatatgtgattatttgtttaatttcttatttcttaagtgttatacacatcaagaaatacctctcatgtggcattaaggggaattagcaggtaaacatgggatttttaagtgccaacaaagagagtaacattatattaaacaccaatgaaaccaaacaggttaacacattggacgtttatcaccactggtattaaatagaaaagtgtgtaattaaactataacaagtaggtggcttatgttgtttcgggagaaggcttttatatctttactgtggtattctttattttaaccctagagttagtacaagttcttcattaaaaatcaaataataaagtttaatatttttgaccaacaacaaaaagaaacaaaaagcacagagtagaggggacagtaactcatgcatgcatgcatccatccatccatccatccatccatccatccatccatccatccatccatccatctatccatcgatccatccatccttccatctatccaattaatacttactctgggactactaaatagtattgttgtaaagtaggggagaaaaaaaaagagagagaggaaaggaaggcggagaggggagaaggaagagtgcataagagagcacactaaaacaagtttacattctatatggtagggtgcggcaggaggcagagataaataataaataacaacaacaaaataagagtgccgtgatagcattcctgaggggttactttacattaggtagttagataaggtctcactctgacttgattcaagctgaatcttaaatgtcaaggagctaggtaagtgatgatctagaacacatcaggcagagggaagtgctaatgcaaaggttgctgttgggtttaggagacagaaggccagtataaaggtataagatgaggtcagggaggtatgctgaggcctgatccctcaggatcttctaggccaagacagggaggttagattttcttttaagcgttctggaaaatgactagagattttcaagcaagtgcaaaactacgtacactgagatacaagaaccaaccaagcacctttgtttcgaactatcttttcaaagatatttgcataatgaacagaagatagaggtagtatctccctcctaagctaaggggtttgttactgcccagaatgataaactggagcaaaggctggacagtcttactacctattataaaagactgcattccctaaattcaggatttccctccgatgacacaaaccactgtgtatataagtgtcacctgtccctttcctatagccctgtgggagtacgggcgcagaaacctaaaaaaaaaaaaaagtttaatctggctattgctattgtgtgagtagcaaaggattctttgtctctgaccccacatccatgaaatggtgtcaagttaacttgttagcctgttagtaggtaaactctcaaactcttcacagttcttgacatatataaacgctagttattattgctaagctataaaataccagctgcaatactagatactttaatgtgcaatccctttaattctcaaattggattctgcattctctaatctggcccagagtggttaagtacttgtttactgtaataaaagtagtaagaggcagtaagttgcaagatttgaaagctagctacagtcagtggttttccaccatattgcttcatattatggtcatgtatattaagaggcagctatgagacaaaagttgtaataaaaatcaacataagaggctgggcacggtggctcatgcctgtaatcccagcactttcggaggccaaggcgggtggatcatgaggtcaggagattgagaccatcctggccaacatggtgaaaccccgtctctactaaaaatacaaaaattagctgggtgtggtggcacacacctgtagtcctagctactcagaggctgaaacaggagaatcacttgaacctgggatgcaggcggcagaggtttcagtgagccgagatcacaccactgtactccagcctggcaacagagcaagactttgtctcaaaaaaaaaaaaaaaaaaattcaacataagaaaggtaggagaagataatcatgggttcaaagacaagtgagtatatctgtatgtgtgtgtgcatgtatactcatgtatgtatctataagggagatggggtaagaagataggttgtgatagagaaaggaaaagcaaatattcaggaatgaaaattctatttcttgcttgagagaaatgaacaagatgaacctacaataaataaataatatatcatgtagcttatttatgagtctaattaaggtataacattttctgatgtgaattttctactctaatgactgaatacatttaaatgtgagtacataataggcaatctgctatcagatataattgccacacccttttagcattcccatgggtaataaaaagtgaaaattacttttccaagacctataaaacaatgtttacatttagaaataaggtctaaaggagttcttaaacctattttgtttcatgaaaaatgcactattgattttcatttaaaagcctacttcatttaaaacataccatattctcatattgtaactattaggagaagaattttagctgaaaaaataccaatagagagcacagaaataggtgagtctgagactaatatccgagttcaaacagtaatttgagattttcttttattctaaatgttaagaagtaaaagtagcttaaaacagaaaaactgaataattaaatgagaacaacatttttctggatatgactgcctcttagtgacttccatcctaaatttgaattaagaaagaaaagttaagggttagccagatataaagacaattggctataagacattgattttttaaaaccatcatcttttcttgaccttgttttatatttagtcagctggcaaataaaccgcactgcctccaactactttcagctacactttgcctaaagaaattctttgagtgttacttgccagacagagtttggtgcaacccccttaccctccaagtggaatgataaccaccattctattctccatttctataagtctgacttttttatataccacacgtaagtgagatcatattatggtatttgtctctcagtgaatggcttatttcacttaatataatgtcttctggtttcatctatgttgttgcaaatgacagaatttccattttttcatttaagtctgaatagtattccattgtgtatatgaaccacattttaaaaatccattcattcattgttggaatcaacatttttgaacagtatgagttggagatccaattcacttttgcccatcctttctccaataatatgcaaagtcacttcttttggatttcaattagcacatgtgtgttgcttcattttatggctgttttagtccatttgatcaatataaccatgtctctaagaataatactctattttaattattaaggcttacatcttatttttcttacttaggaatgccttctgtatccttgggcctttgctcttccatctgtattttagaatagacttgttaagtttcattgaaaaggactataagcatttttaattgatatcttcacaattttgagtcttctgtgaacagcatgtggctttttattaacttggatctttaaaaaaagctttagaaaaaaactcattttctccattcaggtcttggacatttttgttagatttactctctatacatttcttttgctattgtaaatggtgccttcttcaaaaacaatgatttctattgttttgtaacatataaaaatgtaatttttactttttgtagagatgggggtcttgataatattgtctaagctggtcttgaaatcctgggttcaagtgatcctctcaccgtagcctcccaatgcgctgggattacagggatgagccaccacacccagcctaaaaaatgtaatttttatatatgctactgataatttttcttattatttctgatagttttcctataggatttgtttttgctattcatagagtgctataatgtcagcttgattttctcccttttcaatctttacattttcaactcctacttgtcttatcttgctatactgactaggagttagattctaagtattaggttaaagggtttcctttgactcctttcctactttggagtagggtggagggttaaattagttcatggttcttgttttgaaatctgaataggattttctgacttgactgagagaaatttcacaattttttttcccattagactcaatatagtgaattatatttatgaatattctaatattaagccatactttcacttctaggataaactcaatttggacaggaagaatttatctttttgaacatttagtcataaaatacatttttgtattccatttgtttgagataatcatttcattaaaatttggtaaaatgtatctgaaaaacttctaggccaagtatttatttcaaagattaaaagtcattaaaatcaaaattagttatagaactattcatgctttctatttcttttaaagtaatttcagtaagttatttttgtctaggaacttatccatttcatttaccttttccaatactatcctacaaatttttacagaaagctcctctctttttactattttctgtatctttagttatgttcctttttatatcctcaatattatttatcttctctttttcttgattaatctttttagcaatatatctaattaacttgtcttttcagaataacctcatttttgccttttatgtcactttttctttcatttaatctttcatatccctccttctggtttctctaggatcatataaatcctttttaaatttctgaagtcagatgtttttaagtctttctgataaaagttattttattgatacataatacatgtacatattttgggggtacatatgataatctgatacttttatataatgtgtaaagatcaaatcacggtaattggaatatccataaccttaaatatttatcttttatatatgtaggaacatttgacttattctcttaagcacatatggtataaatttataccatttttactgcatccagcaaagtctaatgtggggtattttcaatattgttcaggtataactgttttctatgatttcatctttgacatatgactttttaaatgtgtttttagaattttcaaactagaggttttaaaatttcatccttttaattttatttctaatttcatgtcattgtggtcaataaataaataaaactggcactgaaaaatgtattgagatttcatggtctctagtatgtaaccaattttataaaagttcaacttgtgcatgaaaaaatgtgtattctttaattatcgagtttgaattctatatacactaatcaaatcaagtctgttaattgtttaacgcttgtctttaatgatatttttctgcttatcagtaagttaaagaactttgttgacatttcctaacataatcctaaatctgtcaacttatcgatatagtttattaatttttacaatgtcattttggggctatgttattaggcacataccatttttaaattgttgtatctttcacgtgaattaagctttttgttgtcatgaagtaattaatgtcttgagtcaattgtacctattaacatagtttccctttcttctgattaatagttgccttgtatttcattaactgtcctgttacttcaaacatttctatatccatagggtaaagggaggtctcttataaacagcataaaaccagattttattttttatacgatattacagtcctttaaaaaatttattgtgatttataaaatgtttgtttccatctatttgtctagctttagttatgcctttatttttcctgattttttttggtgtatccttcttagtctatttctctcactacagtttagaatttatacttgatatttctatcctttcactggttatccttgtatttttattacacaaataaatttttagcaacttaacaagacctaaagttaattaatatctgtatctccctttctcccttgactaaaataaagaaaacccaaattctaaatctctctcactcaatttataaatttatgtaacattgttttattgtgtactttctttacatttgttttcatagtacctatggcttcctgtctctcaatctgttttttgttgcttctttaaatacaacctttagagcagaggctatcgaactataatccttagattgaccacgtattttgtaaacaaagttttactggtacatagccacagccgtttatttacatattggatatggctgcttttgcactgttacacgagagttgccacagagactgtattgcctgcaaacctgaaatatttactatctggctatttaagaaaaagttttccagtctctgaaaaaaaatcttttaacataaggatgttgatgaaaaacacttttgtttcctgtttatctacaaatagtagataattccacctgtgctctataaagatcttttgctggataccccaaattagaagaacatttatgtttgtgcatcacttaaagatctcactctcttcagccttccatttttgcaataagtaatctgtatctaattgttgttgctttgggggtcatatcttttctctctggctgcaattttttttttggctttagtgttctgcagcttcattatttatttgaagtgagtctcattttatttatctggctttgtataagttgtatttcctattctatggattgctgatctggaaaattctaagccaccattttgaatattgtctttcattctttttgagtctattcttctgggactttatacaagtggtaggccttgtcatcctgttctccatgtttcttaagaagtattttacacttctaattatactgtccccctggtttgcattctggacaatttatttagatgtattgtgcaaattcaccatttctttccttaagtgagcataacctgctctttaatccattgaatgttaaatttcaaccaccacacttccatttccatacattctatttgcttttttcaaaactgctcctttttagtattctcctgttactttttctctttttaaaaatttcatgttctatttccttaaatatttcatatattgttactaaatatctggggtcttggaggcctatatgtattactttttctgatcatttcaccaaacaatcccttgtttctttgtgtgtttggtggttaggattgagtgttcttacttaattgaacttaatttgtgagaatcttgaggacctaaattgtaactgtcctctggcacagatttgaatttgcttctgtaaatagccagggatcatttctaacctgaataactttaatttgcttttgtcacaggtttattgtaaacattttattcattgtattcaccaagttgtagtcttggttttcattcccagggcaggcctaactttcccctttgctcacctgtgcttattgttcaggtttcaacttcattctttctctttaaccacttttgccttggagatttccctaattttctcacaggacagccacgtttttaaaatagtttgttgtattttggtgggatggatttttaagagtccctagtaaatcgtattgtgataagcaaagtcctcaaaagtatattgttttatagggttgaacaacacagatatcttatttctaaaaaacgttcatataatgtagcagttctcatacagtatgtatttcgggggatactttatacatgtgtgtttcatgacccaaaggttgcaaacaaacaaacaaaaaaagggtaattggacagccatatcaaatgagtcctgaacaagcactcaaaaaaatactgtggaactgaagatcaagaatgccttcaagaatacattaagtatgacatttcatcacttttagaagttgtaaaaaaaaaaaaatcaatctgagcttattgctgcatattataaagacagtataataagagggtagaaattgaaatcatattgtttggtttaaataaccacctagcactaaatagctgtgtgactatgcctcagtttcctctactgtaacatggacaaaatagtgcctgcaatacaaggatattttaagaaataaatgaaataatgcatgtaaatagcttatatcattgcctcacacataaattttagccctatataaatgttaacaagtattattatttctttacaataacatcaacaattttttattattacagtaccattaatgaagtgcctcaaacacatttatccagcaacaattcaagaaaaaaacatatgctggcttatatcaattatatatgcttccatcaaacatatgggggagtgccaattttcatagttcctataagaatatgaatgctttctattcagagatattggaatacgatggtacactgagctgatcaggagtaaaatggttgcatccaatacaagctgcatcacttggcaggaaagctatagtggtaaattaaatatggaaggcaagatgtagttctcaacctcaagtctagctattatacctctgaagatttaatttacatatatatgcacattgtttttaatattctaaatctaatgttcattatgagatttcattctggaaaaaaagagttagctttcctgtgttttctccacgaaagtactactttcacttgaaattagatattcctaaaaaattaacttaaaacactgcccaataatgcaattaacatttgttttatatttttccctaaaagtgcaatttaaaaaatcaatgtgcattttcccctccttctaaaaaaagcattataaacagcctatattccaaataggcctttacttgacaggtatatcagtcttattttatgttataaaataaaattttaataaaacaaaatataaaaatgatagcattaaatactatttagtgttataatagtattaaatactatttaatgttataatagtattaaatactatttaatactatttatttaactattaaagtaggctgccatagattctgactttttgatcgtacttcatctctatttcagtctcagcccatttaaacagattcgcccacccaactcaacatttttcaacatattataatatcctgtatatttttgcgacatagaaaactaggagatttaatcatttgaaaaaaagttgaaaagcttatgaatgtcttcttgttcagagttctatttcattcaacattaatggatactcaagcaatacaagtcagggatctctttaacacaggtttcactaaactcaaaaatctttactttttcctaagtattcaactttgtctcaagtccctaaaatgagattagattagacaaacctaacttaagtctccatgttttccaggggaatgacagttaggtactatgaaaacaagactaattttctcagagtaaacaagctcatgcaggtctcacacattcccactaaacaccttgcttagggttgtttaaccttaataaaaggcaatgcttcaccatacttaattactactttctagaaactcctgatgacttcagctttaggaataattggaaaacattttaatttggaaaaaatccttaaaaatacatttctgtattctcatacatattcctgtagtggaacaggaaaaaaaatttaaaaaattaatactagtcaccaaagtctgtcagaatatagaaattacgtgatctacttttcagttttccattaaaattattttctttggtaactaaatgtaaaaatgtaaaaattttccccaagtgccaaaaacaaacttattatagctactttgtggaaagtaagtttattgtaataattacaagacagatgttttagaaagaaatctagaatgacagtaaaattaatcaaaataatttttctagtattaccaaatccaattaaaaaactgttatcaatgaaaataggagaacatgatatactgtgctctggcacaaacaattcatcatcttaacattcaatatgcgttgctattagttgaactttttatgaccgtgaaacttatgaaaatgggaaactatcctttgaggaacaaactagaatatcccaaaggatgtgcaggtgctgattattaaactatttcagcttaagttgctatttgttgtaaaatcggtctcaggtaaaacaacaaattacttattaacccatcagggatgtaacattactggcccttcttaactttgctatgagtttctttgcaatctcttccacaattcgtaaaattttcaagtaaatgagatacttcaacctattcacatttctttaatagataaagtataagatgtttgtaataaagtttttcccaaagtataatttgatttcccattgtgtgttctcttcccttttgttcagaagtgatatataataaaaatattatttttatctcccaattacaaagctaaatacaagcacaagtcgctatgcacaagatggcagccatagtgtgcttaaaggtaggcttgctgataaggcagcagttttttgagttgctgctaaacacatattcaagggaaacatccaactaaagtcccactagtctcatatgaacctaatttatttatttatttatttatttttttttgtgagacggagtctcgctctgtcaccaggctagagtgcagtggtgcgatctcggctcactgcaacctccgcctcctgggttcaagcgattcccctgcctcagcctcccaagtagctgggactacaggtgtgcaccaacatgcctggctaatttttttttgtattttagtagaggcagggtttcaccatgttgtgcaggatggtctcaatctcctgacctcgtgatccacccactcggcctcccaaagtgctgggattacaggcctgagccaccaggcctagccatatgaacctaattatgtttaaaatgtaacataaaaaatagccttaagttaacatgtatcctctccttctatctctctgtttcctcttgtctctatgtgagggtgtatgagaataatctagaaaaggccactgcatttgatgtacaaagaacataccattttattcatttttttttgtggtattctaggttgtcacctttttaattacatgagttaatatatcttattattatgtattagttattaagttgatttcttttccctatattatcaatctatttttattctcactaccgtattagaataatctaggcattaccttttgctacgttatttcagggaacaaacaaaatactgaaaatgtggaaaagaaataaaaattagcagttattagcagtcatacagaacctggcagtcaaatccagttattatcccatttagcaatgcatagtacgaataaatcttaccaagaaagaaaagtaagccaattagtaaaggtctgtttttactgtgaagaacttaaagagtaaagactaggagaacctatcagaattaaattatttttcaaagttgcaaactcaaaatattcagcacctgaaattgatctaattccttaaataaacaaatactaaaggataataagaaaaacagtcttatagttagcatatttattttgttctaggtttgtggcatttagctccaagtttgatctcagaataacaaatgtgctaatgaagacataagtcttatgtgaaaagactccaaatacaattttcaagttgtaagcccaccaaattaagcaaggatagaagatgcttcctattaaaattgcaaaagctggctcaacactcgaccataggacttgtacatgattttccttcctctaacacatataatgagtcaatctacaagatttaggagcacacaggaaatgcttagtgttttgacattccttttgatgatctagttggtccacacagtagtcagcacaaatggcatttagagttgacaaggatcaaatttgtgtaatctaaatgatttggcaaaatgagttttgttctggctgtcctccctatcaaaaacaattttacactaaaaataccctctgactggatgatttcatttttgtttggcacttcactactttagtcggagaattcagtagaataataaattatatttgatcaacagatgcagcaagattaactgagttaaaattgattttatatttgttcacaacatagatttcaattttataaaccaaaaattgacttaaagtcggcaaacagcacaaatgacaaatctttatctagatgaaacataaatttaacaaaattgtagaaatactctaaagccagagctatacatgtgaaacaggtagctatttatttatttcacagtattctatatgggagcataaaaataaaaaaggataaaatacagtatcaatcctattataatgagattgaaaatgtaaaattactgtacttctattatttgtacatggctaacttgttttgagggtatatgtatgttatgtaatttgattttcaaaaagtaacatccctaagagatgcaggctgttattatcagaaaactgaggctcagtaaggttaagtaatttgcctatacacgtatcactaataatctacagagaccggactcaactccaagatgctctgatgccagaacttgcatctcaactactgctgtcttcccactagaacggcaaacagcaaaacatcactattaataacaaatgaattggctgaggcctatcataggcaggtttcatcaatcacttaagatttgaagaaatcaggactaatcatgtctctctttgagggtcatcacaggcaattaagatgggagatatatataggaaattaagttacgggagaaagagactggattttatgaactagaaaataataactacaaagtttggcacatatgtctatacccatctacaaaaaagagaacaccaatataatgcttctccactttttgtgtgcaataataatcttttttaaggcagggatttttttgttgccctctaaatcttaacctcaaagtgggatttccagatattcaaggtcttagaaactatgagtaagaaagaagtgtagtggcctttttcagtactttaaaatcccatcgggaaatgttcgtgtgctcaaaaataagtcacagaaataaaaatgtattctatatgagaacaggtgatattgcaaactcagagagtccacataacagctacatatgtctaactaaaacagaaaaatgacacatttattttatttattattattatactttaagttttagggtacatgtgcacaatgtgcaggttagttacatatgtatacatgtgccatgctggtgtgctgcacccattaactcgtcatttagcattaggtatatctcctaatgctatccctcccctctccccctaccccacaacagtccccagagtgtgatgctccccttcctgtgtccatgtgttctcattgttcaattcccacctacgagtgagaacatatggtgtttggttttttgtccttgcgatagtttactgagaatatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgtacaataaacatatgggtgcatgtgtctttacagcagcatgatttatagtcctttgggtatatacccagtaatgggatggctgggtcaaatggtatttctagttctagatccctgaggaatcgccacactgacttccacaatggttgaactagtttacagtcctaccaacagtgtaaaagtgttcttatttctccacatcctccccagcaccttttgtttcctgactttttaataattgccattctaactggtgtgagatggtatctcattgtggttttgatttgcatttctctgatggccagtgatgatgagcattttttcatgtgtcttttggctgcataaatgtcttcttttcagaagtgtctgttcatatccttcaaggctggttcaatatatgcaaatcaataaatgtaatccagcatataaacaaaaccaaagacaaaaaccacatgattatctcaatagatgcagaaaaggcctttgacaaaattcaacaaccttcatgctaaaaactctcaataaattaggtattgatgggacatatctcaaaataataagagttatctaggacaaacccacagccaatatcatactgaatgggaataaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcaacccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatgcctaggaatccagcttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacaaaattggaaaaaactactttaaagttcatatggaaccaaaaaagagcccgcatcgccaagtcaatcctaagccaaaagaacaaagctggaggcatcacgctacctgacttcaaactacactacaaggctacagtaaccaaaacagcatggtactggtaccaaaacagagatatagatcaatggaacagaacacagccctcagaaataacgccgcatatctacaactatctgatctttgacaaacctgacaaaaacaagcaatggggaaaggattccctatttaataaatggtgctgggaaaactggctagccatatggagaaagctgaaactggatcccttccttacaccttatacaaaaattaattcaagatggaataaagacttaaacgttagacctaaaaccataaaaaccctagaagaaaacctaggcattaccattcacgacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcatctgacaaagggctaatatccagaatctacaatgaactcaaacaaatttacaaggaaaaaacaaacaaccccatcaaaaactgggcgaaggataaaaatgacacatttttaataagtataatttggtagaaaaattattttgaaatagattacccgtaaggagttctgcaacaaaggggtgtgaagaggatgaaagcattaggaagaatttctttaagatgaaatgttaagcaaaacaagtaagatgtcagatgaaatttgcttaaggagataagagtgttgtactttgctaataattttggataaggaaagagaatagtaaaagaactttcagcaaagttgggctaatggattaattagtacaggcttccacccgtaccaattaggagaagcatcacctggataacagagcattaaagaagagaccatgtagtttgggttatgtgagaaaaagcaattagatcaaaatcctctaatatgaatggaaagtgggaaccgtacatacattatgcttcaaagccacagtgaccaatgaaaggcagaaaaattaggtttaaactcaatggacaaacatgaacacgctacagctgttggatagattaaggaggatgaggttgctcacaagatccaacaaaaattccatgagctcaattaatcctgtagaagcatgatatcatttgctaataacaaatagattggttaatagcatgcagtgaatctaaaaccagtcacaaatagaaaacaatgattaatgctatacaacactacatgaataaaggtatgaacttcacttggtataaagcttgatgcccgatacgccaccgatttactcagcatatagtatgaggtcagatatttccacctagtacctccaatctgaacttttgtcttcactcaagtcttacagtaagtaaaaatctattacgaaaagatgctgaccctctatccttcaccttatccttcaccccagcaaccaggctttacattaatagtcctctaattttaaaagaacacatttcatgttttgaaatagaagcagatctgaaaacattcttctatcatgaacccatcaatgtaaatagacaattattatacccaaggagtatgaaaagaaagtatgccctgtgctgattctctctagtaagttatcaaaaacactcttaaaaattacaaccttggcttttcttgcaaactctctgagcagcaatgtacctgaagctgttaaagaacaggccttggagtcaggcaggcttccattcagtcttagccctaccaactctgaagcttctctgcaaagacatggagcttctctaccctgcagttatctcacctgtcacattctggacctcaaaaaaaaaaaaaaaacactgaaagacgaggtgggacactccatgcaaagcactgggcactggatctagtaagaagtaacttcaaaccatgacagttgttttggttttgttctgttgatcatggtaacaaaaataaagctaaagaaaattacaatgcaaacttactccctatttcttgggaaactgatcagtagttcaaaatagaaccattcccaatgagcacattatctacagtcgattgtttaaaaaaaaaattaattcccagttgagaattctcaagtagaagagaagtgagttaaactgctgtcaaaataaacagctgttcctcagagaagctacaagattttgaaacttttcccccttgttctacatggcttgaggcagcagtctggaacagatattccttctttagctattgtaacaaggctctcatagagcaaacaaaaaaatgaactcgaagggctgtatctatacatattagtcgtgagattctagaaacactgaggagagactgtatgagttagtcaaaggtatagcaaaaagcttttaaacccagcctttaactacttaagtttaaatcccaagacaatcttaaactatacatattttagatcaattatttacaaaccaaacgattgttccaaaaaaatggccactttttcttttcttctattgggagaggggttaggtttcaagctagtcccgtttgacacagcaatagcagttatgcatttaatagatgttaacgcaggtcagccacatatggtatagactgtggagccagacagcctggaaagaatcttagctccttggcagctatgtaatgataggcaagtcaggatctctctatacctgtttcctcatctgaaaaatgggaataataacagtacacataccacatttagttgctactataaggattaaatgggtaaatatagctccagacgcatggttagctctatatatgttagctattaaatcacccattgatcatctgttactcaacaaatttatctattatatgccatgaattgcactagagacagaaagataaatatgacagacacagatcttactaaaggaagaaatgtctgaacagagattagagggatgagtatgataatttagccaggcagagtatggagaaagtgctccaaacataggaaacagtaagtacagtggtctgaacttgagagaaaacattgcatggaaaactgccaatgggggagtaggtatggagtgaagacagtggttccaacccctgatatgtaatacaaaaattagccttcactttatgataaaagctcattcatgaccagaagtatacctaaatgccagtggatgaataaacaatggaaacattttaacagtactttttaagaagaaaatttttgtctattaatggggatttccagaacaagatcttcaacaaataaaactctacatctttctttagctacatatctaagatttccgtagtgactcattcacattaacctgattttcaaagttgaataatacggaattaaagagcaacctaagagatcagaagaccctgacaaaacgagacatttatttgtcaggagtttttgccaatattgctactctggacttcaaagcgatatattttgtctaaaatttaaacaatataaccatatttaccccccaaaaagaaagaaaaatagaagagaataaagtacctgtataaaatctcacaaccttgttacaatcacttcccttccagccttcatgcttatttttctcctaaataaaatttcttctatatactattctttagatttaatacattttaatatttaatgttaacaattttaatttagtgcagtgtacacatgaatgtgtgtgtggtggtagtgacttctaggaccccatgagaactctgaaacaaagtagagctgtcactctgttacccactttttggaacccttttcccattcaaacactttctctctctgcccactatttgcccacatgaaatgccaagttacccacagaatgccaaaaccctctaatccttttagatctatttacctctattatatgcataactgctactgctgtgtccaacaggactagcttgaaacctaacccctctcccaatagaaaaaaagaaaaagtggtcattttttggaacaataatttggtttgtaaataattgatctaaaatatgtatactttacatagttgggatctggattcaaatcccaactggatcacttacaaacaatatggcattgatctcatttggaaaccctccaaacgtcagtattctaatttgtgaaatggaacacaaactgtagaatacaagaggcagcatgacataatgtttaagagttagggcccttaaagaaggctttagagaagattatatgggtttaaattctagttcgaccattttatagcagtataacactgagctggatatgttccttctctgtgcctcagcttctttatctgccatagaagaactgtgtggcttgtctgacatactatatgtaaggcatttagaagaatgcctggcttatagaaaatacttagaatagaaggatattattacttcatatatccattttatacttgatgcataattgtgtcagaggtccccaagacaccctcatgtttgataatttgccggaagggctcatagaactcagaaaagccattatattcactgtgatggtttattacaaacactattaaaaggaaaaatgtgcaaagggcagtcttcaggagaaaccagatccaagtttcccattgccctctctcagtggagtccaacagacaatgcttcatcatccccaaaacaatatgtgacaacatgtacaaagtattgcaaacctgggaagcttctgtgagtcttggtgtcaaagattttattgagagtcagtcactttagcatagactgcctggaagactaattttagctattctatctccagctcagtaagaggtcaaatggagacagtgtggcccagggccccaggtagacaaaacaggtgttcaacataaatcacatcattagcatatctatataggttggcccaaggccccaggtatataaaacgcccttatcaggcaggatatttctaggtctcttagtagccagtcaggggccagtgttctttggaatatgaaggttttgagcaccccaagcctgctgaattaaccctttactgtataataatttattgagcaactaccatgtgccaggagctatgataaacattaaatatatattatctcatttaatactgaaaacatttttatggggaaggaattcacattacttttttaaaaccaatgtggaaactgaggctcaaggttaaacaagtcttcagacacataactcgtatgaaattcaaatctagctctctcagactgcaaagtctttactatttccactaagccatattgctttacaaaacattacaaaatttaaaataatatattgcaaagtatgtgacacatacaggtatatcatatttattaaccaaattcatttctggcaatgaaaaataatttacagaattgctttgaatttgtggagaaaataaattagaactgtgaccaaatgtgtatttttcctgtaaattagttttcctttaaaaatagtgtttttattaaaaggctatctaatcctaactaaataattataaccaagtccaacaacctcagcaataaagttttcctgagattaaaaagaaccagttctttaaattcaaccttctttttcttcacacctcaaaactttttaatcgccacaaacaattgctaaaatacagaaatgacttacccatctattaagaataacaatttttcattgtagaaatatgtcaccagtttccctagggaggcaacaatgccttctcactttaatatgtgtgtagttcttttcttccccccacctaatcagctaatatgtttgaaaagatatttttaatgcctaaatgaaaggattccacatcaaagacctgacctccctattaaagtatcctaaaggaaaccctacgaatgtaaaacctattcaaaggcaaattgcgtgtagcttattgtacaatgcattaaggaaaaaaagccttacaaaagctgcaaggaatttggtaaaattatatcacaaaaatataaactgatcttgaagtataaagaaacaaattcatagccaaaaacttattacagaagtgctctgtaattagccagcaagggagtctttatgaagaacttcagaatttgtcactttttcaatcaaaatgtctgattacagcttaatgttggaaaggccaaaaggagaacaaaccatacatttttcaatagatttttaaatctgaaattttatagctttcaaaatcagaaaagataggttttcctacagcaacaagagtagaacgatgtaatgagataatagataagatagtataaataaaaaaactttttaaaaaacaatttttttaccataccatgaatgtggttctgaagttattcaggtcagtaagaaagtcttccacagacaccttcttcacatcaatggcatagtatcctattatactctggtataacttttccatgttttcgtgtaacttcgaaagtgtctcatattgttcttttgcactgataacaaatctgtatactatagttaaggtattctgaaatttacaaagtaatgctttgggggcagggggaactctgtaaatccaatgttttagtctaatagccaccattactatatttccaaaattctaaaattacttctaatagttgaccattcttaaagtcagtctatactacatagcaacaaaatcttaaattcaatttccaattaactttgggaaatcattagaaaagatttatatatttaatatttctctttaacaagtttaaaaaatctttcttccaacttactataataatataatatgcagatcatacaatatgatttaaaattatagttcagtagttgcagctgaataattgcaatgatattgaaatcaacagtacaagcattaaacacaacagttaaattggacatcttgggatcaatttctagctcctatacttggtaatagtgtgcctgtgggcaagtgccttcatgtctctgtgcttcaatttcctcatctgtaaaatgggaacaataatatcaccaactcacagggctattgagaggactaaatgagctaacacatgcaaagttctcagaaaagtgggcatttagtagcacacaaaaatacttgttatcatcatccctcacttattttaaactttaaggttctaaaagcaaacaaaattttaagagttaaactgaaaacttctcccattatctaaccaaattagtgttccaacttctcttagaaaactggtatataatttctttatgcattagattattaaaaattatgattacacacacaggcacacacatatagaaacgttcttctctcactcatgacaatatatttcaaaacacactgaaattaagaagatgaatttaatgtgaatgtgacagccactgacattagaaaacattttctaaataaacaatgaaattttttttcttgtgtggcaaattgctaatgcagtcagatataacatcactataccatatccagaaaaaatgattcttttagagcatcactcataattgcctatggctcctttaaattaacatttaacgaaatggaacatagttaaatttgcagaagtccttttactaactttgactagccattagcaaaatttaaaacaaataaaaaacagtattcaggcaggccaagagaaagaagctaaaaatggaatttttatatctaaaatttttttggcccacaatttcaaaaagatatggttcttctggccagaacttacatcagtagaggatgaaataaggaaactgatgcaggtccttttctttgagaaaaataatgaaagaccaaggaaaaaagagacagcactactgccaggtagggagtaaatgtaggctagcatatgaaagaattctaattcttcatcatcatcttcatctaaaagaaaatgcaaatgtagttagctgtccttgtgcaaactgttaaactccaacttctgtattcgtcaagagctttggaaaaatacgtgagatactcaacaaaataaacatttcataaaattcattataaaaatattgatataagcccaattacttgatgttttgggaaatctattttgttttcctttaccaacactgaggccaaattctcatgaatttctactagaatcactgtcatcttcccatttgagaggtagataacaaccagatctgtgtttacatgcattgaaccacaagtgttaagtgttggccagctatgacttggaattctactcctggtatgccagtattgctcattaccaaaccacctaccacaaatatatcccacatttatttttaggtcatactgcctttattacagttctgtcactgaggatgcccataacttccattaacatactttataaggatcagcatcattcagtcctatgtgtctaatatatttcatagactttcttaagtacacaggatccagcaagccattcagtaagtattatctgagttccactgtattctaggcactaggaaaaacagtagctaacaagtcaggcaaagtccttgctgtcaagaaacattttagagtatggagacagataataaacaaatgaatcagatttttaacatagtaataagtatgatgtagaaaaaaaatatgatattacgtagagtgacagaggttaggtagttaaaatcttggctaagaaagtgagattgactaaaacaacagaggcttgactgttaaagagcagtgagctgtccattgggtagtactcccttgtaggtataagacttcagaaaatgaaaagattattataaatttggggactcagagagaattaagaacagcacatttaatgctagttttaaaagtctgctaagaaggaattaagtggaacacaggcaagaaagaaagaacagaagaagaaaaggagaagaaagtgagaagactaattcaagagaagaaaaatctgctacaataaatcacccaattgccccacttcccactcttacaactgggccgtgtattatacaagtttacatttcatccattccaatcttctattttacttcctagtcgccacagttcaaagttcaacatactaaattcctttatctgaaaaatgctgtacattatgcagtgtagaatatagatataagtaaatctttctctcaatgaatttactgggctggctttagcatctacccagtgatttcagaagtttctaaagcattgctatatagaataacacacaaaaaaagtgtgaaaataaagtgggatttcaatgaacaaatttaaagaatataacatggaaaggagtcaagtaacttgtcacataagttgtaataaatacagaaatatataaatgtctagcaaaataagtttttctgaaagactcaggagagggagtaggaagaaaatagaaaggcaagtgctcaggcaagaagaatttcaagtgcaatgctccaaattctatttgttcttctccttaaaataagacatatcacagaatttaaagatcatgagaaaggaacaagcactacatgacacaaatcctggcatattcttaattttctcaccgataaaaatttagtaagtacgtacacctcacatataatagcttgcatgtaacaatactgatatacattgaatttggtttcacatttttcaagcaagtagttactgtggaaatattcaattctaattaaggctctgactagacttagcaagtgggaggtaataattattactaaaatgtcaatgatatttgaaataatagtgcatcctttttaaaggatgcactaaattcaattttttaatattaagcagtatatgtaaagagtaagcatacacagaaagaataaaaatacaacatactatcatcgagtgctattagtaaaatttcacattacaataaaattgtatcttaataatttaaaacaattcaattaattgatttaacagttcactaaattataattatttaagtacgtacttgtaagatacattgttaacaaatttaaaaatacacatattcttccagaattggtgaatgaaccaaacatttgatatgtacctcgatgaataagcatttcaatgaaaaacatgaacaaagtttaagtggttaataacaaactttaagtatattttattcattgtgcattttagcttccaaattcttcaattttttaacatctaagaagctcacaatttgccattttaataagatctgtataaatgcatttaatatgcaaaatctgacatgtcagtcctaattaatgtaaacaaagactcgcaatgaatgaatttaattacttcgaaactagtatgtctaactaagatgaaaagcaaacgagtgcaatctaatctcagcaaagaatatttatgattataagctttgtcaatagcaaagtgcaccaactgttcatatatctgacttccaagagatacatgaatgctaatcagttcattagaggcttctaggttgtgatatttaatgacaggatgtagtagctttcttgtccatggagtataattgtactcagaatgaaaaattgtttccaacaaagcatcatccttcctgtttctgatttcctgctggttgctttttatgagccgcatacctttcaagaagccgacatcattcagtttcttgtgtcatataaatccaagtatagatatgtcctgagatcgtgtgctaagcaagattctacaacctttactccaagctcaggaattcatcttggttctataaacctgagcttcataattagtgcattcacagtgtactaccagaagctacatgcaagcaaaatcttttctgaactgctttatatctatagggaacaataataagtagttcaattaacagtacttagttattaacaaactgtcacatatgaatattttaacatgataaaattaagaaaaaagctaagaatgatgaaacatataactgcaataatatatttattttagaaagcacactttgtcatatgagaaggtagtacaaaaaaatttttgatgaatacagatttcacctttacttaaaaagaaaaaaaaaaaaaaagccttactcagtagggtgataaaggcatcctccctaatgaaataagaaactggatgggtggcaagatacaaaaggaaacaaacacgttagcctgaattgattgttgctggagtatatttttatgatatttcccgacagagacagtgaaggaagctaaaactcaactagttcacaattaagctgaaagcatatacaataaaatctatgacaagccaaatattaattttgtgattcactaaatctcaggagagaagaggtagaaagaggaaaaatagtcattttatttcaagtacctcagtttaagatattaggagtgtctatttataagagctcattttagaagtgagttatctttcatacagaattcatttgtccatatgggattttaataatgcattgtagtaatattttattacaacacaaaagatatcagtctgtaatttcataaaatggtttgcaaagcaactcaacattactttcaggaaataaaagtttattacttcagttactcattagagattaagctacaaagttagtgataataaagataattgaatacaaaagaaaccttaaacaggacacaagcctcatgctattaattatatatgtgtgtgtgtgtgtgtgtgtatgtatatacacacatacataccgatttatttgggttaggaaaatatcaatacaagtagtgactataataaactccattttgattttataaccatctagtatttctaaaggaaatattaaattttatggagcacaaactaatttataatatatgccaattcttgaagttaagctgactagttaaacacgtttatgaagtcttgtatctgcttcctcagacatttcaaaggtatctaaatcacatcatgagtttagagtcaaacttcctcaacctgagttttaatatcctttcaattcatcatgtacatcagaaggaaataaggtatatgacagggaaaagatgagagaacatactattatctaagctgataaaaaggaaaaaaatagaaattaatgatcatacatttgtgggtgggcgtggtggctcacgcctataatcccagcactttgggaggctgaggctggcagatcacttgaggtcaggaggtcgataccagtctggcgaatatggtgaaaccctgtctctactaaaaatacaaaaaaattagctgggcatggtggtgcgtgcctgtaggcccagctacttgagagactgaggcaggagaattgcttgaacttgggaagcagaggttgcagtgagccaagatcatgccaccgcactccagcctgggtttcaaaaaataaataaataaataaataaacaaacagacagacagacagacatttgtgtattattcatgattgacagacactttgataaatttccctgcaagaaggcaaaggttaaactttctgtaatttggcactacagaatgatctctggttacacaaagacatctaaaatattaaataaattgtatctctagttgactagtgacttaagttatttagctatcaaaaggatatggacatctttgtcacaaacttgtcatgcaagtcctcaggagggggaaaggtttccaattccttctcaagctgttgaagctgccttcccatctgcctcaaattcttttccagcgtttctacagagactaaaagagagtatattaaatgcccggaaaggacaaaattataatatataaaaggtaagacaccctagaaacaaaacattcatgaaaacaactcacaataatgtaagaaaattcattataaaataaaaataaatttcacttttaacctttcaatttaaaatctagttataaaagaaattcagtaagacagtctttaaaacgtaagacaaaatttaagaaatgctcacacacacaaataaaccacacttcagaaataagtttcattagaattcttgaccattggaaatactacaaaatcatcagtctattcagagacaaaaagaaaacattttttaaaattggactgatttaaatataatttgaacatttttcaaaatcatctcttgacagggaacagtgagtagatgggaaagatggggaaaagtgttttttattgtccaagcttatctacaatgggaaagaaaaggtatcagaggctacttataatgacaaatgtcaagctttctttgctgatatcctgaacacaatttgtgtttattatctaataatatttttccttctttgacttaaagtggctctcacggtacacatgaagaagaaatggtaaaccagggcactgtgtcactatgagaatatactagccacccagcagaacagacattaaggatcatttctgaaaatcttttcatagtcaattttatatgacaccaggaaaaagatttaatagtgcaaaaagaagatagagtgacctaaaccaacttttaaaatatttgctttaggtacaaatgaattctaggttaaaaaaaaatctattgtttttgttcaatgtgaactatataaaatgatgtttaaagaatgaatacagtaattcaaggtaatctgccattcttaggatttgaattaatcctgaaggatttgaattaatcctgaagaatgggtgcaattcaagttttatctataaggataggaatatccttggaagcaatctaaatgcccaacaaaatgaaactgagttgttttttttttaattttagcttggttcaaaagaataaaatagtaaggagacattaaaaataatgtgtaagaatatgaaatggtgttttattgtttttttaacctggttgtacagaaaataacatttggtattctgacattaacagcttttaataaaacctaaatgtattttcttattttaaaaaattagcaatctaattctcagatgcaacgtttaaggagtccaatgattgaactcttccgagaaccacatataatacttgtttgtgcttgaagagtgatggtactttaactgtttgctcccactatgatgaagctagtctggatttacactcatgcatattttctcagtaggttttttttttccttctcacgtattccctttctgtgatactttgaatttacacactaaatgctataataatacacactattatctgagtcattgtctcaaatttaagaatcacatattcttacctttttaactatttaaattattccaataccttgctgtgcattgctcatagtggtaacatatatttcctatgttatactctttcatttttatgtctgcttgtcaattatccacaaccaagattctatttgattaggccaatggtgtttcatttactcttcccgtttccaacttttttctttgcttctttcaaagttctctatctgcattacataagagattccttttgctctcctagtctatttgatctctcccttaaagtctcattagcatttcctctatcatttttcaagaactcttacaggtggttcagtcactttttatacttcctaaaactctgcaacttctgactaaataaaggttcaaaagcaagctgggcatggtgatgcacatctgtaatcctagcactttaggagctgaggtaggaggatcaacttgaagccaggagttcaagaccagcctggacaacaacaagactctgtgcctccaaaaattaaaaaaaaaaaattagccagccatggtggcatgtgcctgtagtcccagctaatatggaggctgaggtgggaaaattgcttgatcccagaagtttgaagctacagtgaccagtcatggcaccaatgcaccacagcctgagtgacagagcaagaccctgtctcttttattaagtaaatacatgctcagaaatgtttataagccatacatctactttgtgctataaattaggttcaaaaaagtagtgtattagtagtataatggtagcagtaattgttatattagtagcagtgacaataaaaataatagtaatggtaataacaacatctaaaatgtggtaagtgtttatgtatgtcaggtaccgtcttaagtgttttctattaattaactcatgcaatcctcaccagaacatcatgaagtaggcattattattattcctattttacagatgaggaaactggagctcagtaggtaagtaaaaaggtcaaattaaaaattggtgaagctagaatttgaattcaagcagtttcattccagaccttatttttaaccactgtgttatatataaattattatagaaattaccattttgttttcataacccctgtcagtaacatttaaataaacagatataattttcacataataaggggtttcttgtacattcttgcccattgcaatcacaagcaatccatattccctgcctaaacccagggaatatatgcctaagcattctggatggacgggtgagtgtgcagttatatatatataactttttatatatgtatttatttttaagtactatatatattaaagtggtatctcaccttgaacaaaaccacatacttaaaatacttagtctgctcaaccaattttattatgcacacatgtcaaattagcaaaagatctagagaacagaccaataggtctgagggactcccatatgagaaaaagcacagggcaaatgttgggagggaacatagattgtttgattttttctctgacaccaaatacattgttccaacaccaatcaattgtctaattctccaataccaactgggtgtcctacaattggagttagtgcagactccataagttaaggagaaaatccttcaattccgatactaactacccagatttagtgtcaggctgtacaggtagaagggctcactcccacaaaactaccctcatttcagatgccagttgccagtctagaggaccactctagactgactcgctataaatctggggattcccaaaactcccttccctgaagttccacaattcactagaatgactcacagaaatcaggaaagcactatacttatgattgtagctttattatgaaggacacaacccatgaacaaccaaacggaagagaggtacaggacaaggaatggtgggacgggggtggtgcacagtttcactgcccttccagcacttccaccctccaagcacatccatgtgttaccaacccagaagctcccccaacctctttcagtctttattgaagcctcattacaaaggcactattgattaaatcactggcatttgtgattgagctcaatcttcagcccctctcgcacccatacattgggtataagcccacagttctaaccctttaatcgtatgtttactacttctagaaaccagtcttcatcctgaagctatacccctacctgtctttagtcactacattaacatacaaaatatgtgtcactcaggaaattccaaaacttctaggagcttcgtgtcaggaaccagggggcaaagaccaaatatttacttttcattgtaccgtatggatatagaagtacatgtctggtcagagggcagaattccagtagggaggtgtaagagaagcacatttttggctcattctcagaggtgcctaaagtctaggctgccctcagaggaagccagctactggtaactgaagatagagctaccccaatgagtgagtgcttctcagctaggtgggagagggacttagtccactggataaaaggcctgtgacttttccaattctgtggttgtcagtgggtcaggaactatgctctttatgattggaagcaatttctcctgggcttgatttccacattagtgaaatgagaaggatctcaccgcgtatttttacctcacagacatttcataaagagtaagcaagctatcttcaaaaaaataaaatggttcttgaggctactctacagatgcaaatctcactaagccatttcttgtgcttcaccagaagtctctgattatttgcacattatttgcacattatggttaagcagatttaaatgtaattgaccaacctctcacttggtttttaaataaggaccaacacacacttggaagaaagaaagcagcgtgagaattctgggctaagaaaatgtatgccatctgatgggtaaaactaaagagcattttaagaattcccttgctgtatttataagtcggatctgaataatgggaacacatggacacagggaggggaacaacacacagtggagcctgtatgagtggcgggcaggaggagggagagaatcaggaaaaatagctaatgcatggcaggcttaatacctaggtaatgggtttatagatgcagcaaaccaccatggcatacgtttacctatgtaacaaacctgcacatcctacacatatatcccagaacttaaaaaaaaaaaaaaagaattcccttggtgtttttattttttcagcaattattctatttctatagacaattcttgtatgtatcttcaaacataattttagccacatttttcacatgtatcaggttctttgaggtcaggaactatattttatgtcttaaaaatcttaactatatccagatcacgaggtcaggacatcgagaccatcctagctaacacggggaaaccccgtctctactaaaaatataaaaaattagccaggcgtggtggcgagcgcctgtagtcccacctactcaggaggttgaggcaggagaatggcatgaacccgggaggcaaagcttgcagtgagctgagatcgcgccactgcactccagcctgggtgacggagcgagactccatcccaaaaaaaaaaaaaaggaaaaaacaaaacaaaacaaaaactatatcagggagtattaaattgtacactcttaaagaatttttaatttactggtgtctctgtatgtgacctatgtgtgaattttatctttcaatcttctcaccaagaaattaatcatattttttgtattcctgttcattctttggaagaaaactaacaaaacagagccatcatcaaacagagctagctagacaattttgacttttgcattttcctcagttaacattccaccagatgacatctctcagtcacttcagacatcatgtgtctctatctccaacctgctccctatgtgtaatctccataccacagaaggcaaaaggaccataaatcccatttcttgtgctagaaacctgctggtcttgaccctttcctctcttgcaattctcagattcaaacaatcatgacactcaggcattttacttgacaaatagtacttaattccttcctgacttaacacctttttttctttctctttttttttgagacaccatttttttcctttttccttttttttctttttgagatggagtctcactctgttgcccaggctggagtgcactggtgtgatctcggctcactgcaaactccgcctcctgggttcaagcaattctcctgcctcagtctcctgagtagctaggattataggcataaaccaccacctggcttatttttgtatttttagtagagacggggtttcaccatgttagtcaggctggtcttgaactcctgacctcatgatctgcctgccttggactcccaaagtgttggaattacaggtgtgagccaccgcgcctggctgacttaacacttttaaagtcatagggaacccttttgtcttctctgatctctggtctcctacagtttttctccagcgtcattttcacactgtgcataggggtttccagacaatcagtaaagctgcccctttcctgttcaatgcatgtcagtaaactggttacataacatctgagttcctaaacaaagccccacctacaacctggggtgctctacttcatatcctgccaaatattcatctccaaaatacatactgcttatagttcccctgcccatatccctcttcatctaatctgtacctgatcctggaaataatgtgtgtctatctgccttgtgcacttcacccctgggtcataaccattcataatttacaaggaatcaaaaactacagcaagtacacaggtaaagtgccctttctcccaatcacaactagtaattatctctatctttgcaattactactctctatttacatttatctttttatctgtcttcctctcccaaatggctgggaattccttaagataagacaccattcatctttgtattttcgttacaaaacatattgcagatacccaaatgtttgctgaaggaatgggttttggatttaactttaacctcgccagataagagcgttaaaaatgaaacaggaaaatataacagattaaatatcccagacattaaaatcaaagacacaggctttcctccaagtgtcttattattatgataattatacaccagaggtgttaaagaagctttagagtaaaagttaaaatcgaaactataaatatttaagtttaaagcagtcatgaatacatgctttttataacaccatggcctctatgatttactagattaagatttcaagtaagaaaggagaggttacataatctttgtaattaaaaaaaaaaatcctctatgaatatctcctggaggtgttggtcattatttcataataagcttactaaaaaatgccacactcactcttacacatcatgatacaatccagggaaattgatttctttaaggaaagcttaaagaacaacttattaccatagacaatttaaacatgcaaactaaatcaaaccttcctacactcatagaatcaattgtttcatgtgcaaaattatttagtttcaggctccaagcaatatatttcttcctagacaactgtaataataaaagcattttataaagctatagcaacattttataaatgcaagttaaaataataaaattgtatggacaaggtggtccaaaacaaacctcagtagtataaaaaaaaatcttgactattaagtaggtctacaacaaaacctaaattctagaataccattataaaatccattacatgacaaaaagatacaaaactaaaacaatactgaaaaaaaatcaaagtaaaaataaattgtagcttagttcgtaacaggcaaagataaattgaaagaaactgtgctgccgggtgcagtggttcactcctgtaatctcagcactttgggaggctgaggtgagaggatcacttgaggccaggggtttgagaccagactgggcaacacagtgaaaccccatctctataaatttttttaaaaagattagccaggggtagtggtgcctgcctatactcctagttacccaggaggctgaggcaggaagatagcttgagcccaggaatttgaagttacagtaagcaatgattgcatcactgcactccaacctgggcgacagagggagatcttgtctcaaaaaaaagaaagacaaaggagcaatgctaagtgaacagccagtcatcctcatcaagtagttgtaccttccttgacttacctgactcagatcttctttcttcccattgttctgattcttgatggaaccccaggtaataacaaatggaatttgcattccttaattaatttactatactgtatgcaatgatggtttaatttttgttgtttttacataatactgcaagagaaatgccttcatctgctatggaacatggaaagaagaaagggagaaggcaagtagaggaaatgaatacaaccaattaaaggcccccagtcaattctgttgagctatttcatcccctgaaagaaagagccagccctgtcctttacaagtacaaagagggtattaaaggcggcagccttttagaagagaaagtgtattagtgggagaagcccatctcaaaggaaatcatgtttacctataagatttcagaattcccttagataagatgttcaaaaccatggtataaatattacataagaggtgcataacagaaatgtttaataacaatattcaaaatgttcccttagtataatggttctgtgtacatgtacatgggagggcaattttactgctttttactttgtcacaggggaaatgttaagcacagactgactgactttcaagtaagactagttttcacttgctgctattggagaccaggtcagcctcacaattccaagattgtgtattagctggacttcaaaaaagtccaaattttttctcaagcctagatccttcccctgaactccaatggcctatttggacatgtttccttaatatttagctggcaccttaaactcacttttccaattagaatttatcttcctccttgacttgcccctacatcgcagtaaatcattagtttttataactcttttctctttcatgccgcacacatctaaccatagagcgcatcttgctggttctaacctcaaaatgcattcgttttccaaatacttcttaccaccctcactactcttcccgatccaagccaacattattcctcctctagattattttaacagcatcagagtggttttactcattctaccattattcatctacactttttcctcaacagagcagccaaagcaatcctttgaaaatttaagtcagatgtcactcttttgctcaaaaccttccgtggcttttgagtggctcctcatctcagagtaaagtcaaatctttttttttttttttttaattattatactttaagttttagggtacatgtgcacattgtgcaggttagttacatatgcatacatgtgccatgctggtgcgctgcacccactaactcgtcatctagccttaggtatatctcccagtgctatccctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattatgtgaagaaagtcattggtagcttgatggggatggcattgaatctgtaaattaccttgggcagtatggccattttcacgatattgagtcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttattgatttttgtacattgattttgtatcctgagactttgctgaagttgcttctcagcttaaggagattttgggctgagacgatggggttttctagataaacaatcatgtcgtctgcaaacagggacaatttgacttcctcttttcctaattgaataccctttatttccttctcctgcctgattggcctggccagaacttccaacactatgttgaataggagcggtgagagagggcatccctgtcttgtgccagttttcaaagggaatgcttccagtttttgcccattcagtatgatattggctgtgggtctgtcatagacagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagtagcacatcaaaaagcttatccaccatgatcaagtcaaatctttacaatggacagtaatgccctacaggatctattacctttctgaccttatctcctattatgctccccctctctccctctgctccagtctcacttccataccttgaggcctttacacttgcttttccctttgcctggaatagtcttctctcaaataccaacataaatggcctctctacgactcttttatgtttttctcaaagaccactttctctacaggaccttttctgaccactcaatctaaaactgcaaaaaaccctgccctggcatgccagagtcagacataagacatacattgacttctttcattggcttggttctatatctgccacctaaaatgtaaacttcaagaaagcagaggcttttgtttttacagctctttggtgccttggaatggatgaggtattcagtaaatgactgattcaacaatgaatagatgaatcttttttttttttttttttttttgagacagcgtttcgctctttgcccaggttggagcgcaatggcgcaacctccgcctcccgggtccaagtgattctcctatctcagcctccccagtagctgatattacacacatgcaccaccacgcccagttttttgtatttttagtagagacggggtttcaccatgttggccaggatggtctcaatctcttgacctcatgatccgcacgcctcggcctcccaaagtgctgggattacaggcgtgagccatggcgcccagccaaatagatgaatcttatttaaactaactttatttttttttttctgtcactcacagtcaagcctaatccttgctaatacaagtgcctagcacaatgcctaccaaacaggagttcaataagctgttttgagagtcctttccttatagagtcaaaacatatcaaaaactactaattaacactagctcttttttccataaaatatggtttgaaagatagctgccaagaagccaccatcacagtggtagacacttatatgacaaaagggtctcactgctgatcaattttaaatctatacttaaaggtgatctcttctgaggggagaaaggacgattacccaatatcttattttctttaggttttcctatgagcgtgaataaatattattttagattttcctagcacttatatcatttctcataaagtagttcatatttccatatggcattccttcataattcttggctgaaatgaaaaaatttcttttttaaattcatgcatcacctccagaaaaataaactcagagttgaagagttgctggagaccagttgttttcaaaggttgtttagtactagaactccgttttcaaaagaaatcttatgtcaaagttcaaaatacaaaataacgtgttgcaggctgaagcagaggcagaaaaatagaactcattttccaaattccattccctatgttagtatgtccaactcgtaaaaatgcattgagctgtacacttatgatcctgtacacttatgtaactgcatgtgtattattctttaatttttagaaaagtaccaacatttttagaaaactactaacataagcctacaaaatttgcagtcgttatgttctaaagtttgaataagcttcaggcaacacacagttggaatctgttcaaatttctgacaatacatattaaaattctatactaacacattattcacatagactcatgtttacctgcactgttaatgacaggcagatgtgtgccaacaataaataatcacggaaaaataacacccacactataagaaacatggagaatatttatataatgattaataggtacttttcaaacttgataaacatttgtacatattaacctatttaatcctcacaacaaacatctgggttaagtactaatattgcacccattttataggtaggaaaagggaagctcagacagaataagaaacttgtctaagattatacctataacaagctggggtttcaactccaggtgaaccagttacctaacctcagagtccatggtccagataacagtttctcctatcatataatgtttctataatctaattgcaaacacatttttaattttgcccactaaaatcacttattacagttattgctgttatcatggcctatcaataaaaaaattccttaaattcacaggctgatatggtttggatttgtgtcccctcccaaatctcacgttgaattgtgatccccagtgttaaagaagggcactgataggaggtgattggatcatggtggtgagttttcctcttgctgttctcatgatagtgagtgagttttcacgagatctggttgtttaaaagtgtgcagcacctctccctgcactctcttcctccttctccagccatgtaagatgtgcgtgctgctcctttgccgtctgccatgattgtaagttttctgagtcctccccagccattcttcctgtatagcctgtgtaactgcgagccacttaaaccacttttctttataaattactcggtctcaggtagctctttgtaactatgcaaaaacggactaatacaaaggcatacaataatttcagttttaactggtttagtattttcacacaatgacaaagaaaagggtatttctgaagcatattaacaataactttaaaaaccaaactatttcacaatttaatgatacatgctttccagatatgcttattagtataatttccatgcactgtttcataatactcaaagatgacagtgctatctccatgcagttataggacttatgccaaagatgactgtagtgggtgagtagtgccccccaaaaatgcatatccacccagaacctcagaatgtgacttatttggaaataggaactttgcagatgaaattagttaaggatcttgagatgaaatcatcctgtgactgacatcatccaatgactagtgtccataagcagaggtgaggaccccgagagacatggagaagatggtgagaagatgcaggcagagagtggagtgatgcatctacaagccaaggaacacgaaggactctgagtagccactagaagctggaagagaagcatggatgcttcctcccctggagtcttctgaagatgccaaccctactaatactatgatttcagagactttagtgagagacttaatttctgttgtttacaggcactcagtttgtggtaattggttatggcagccctaacaaaccaatacaactactaattcaagattctgtaagatgcataaatacattctggtttctggagagcagctgacaattctacctgcagcatttgattatctccatacctcttcccccaattggttacatgtcaaccttgtctccaacaagattcataagattgccattaatgtgtttgctctatctactgcttaggtttctttgtagtacacagatttgttatgttaaactgtccttcagaatatactattctgaaattttctttcacctacttcatattgcaaaactaaggtgcagtaaatattgctttacagccacaagtgtaagagagttctaaaaccttggtcatcactggtgatactgtcctgttacttgatgttcgctatagttcataggtgacactgacagaactgctcaagtagctacttcaaatccgtagctggcccaaaatctgcaaacactgtaaactgttagtttctcgaaaagattaatgatgtattgatgacactttcagcctgttaacctccaaaaagatatagaggtcttcctgatgtggttttcttcttcatcatcatctattagcccaagccacagcagattcaggaaatgttcctagctcagtatctcaaaaagcaatctttagctgcaagtagttcctctgtgcccagtgttctttaatgtcaatctacagaatccttaatccttctagtgatttttgggacattctctttctattccactctgctgctttccaacacagtttatatttgcactgcaaaatgattactcttacaatctcatatccaagtctacaacttaaacttttcatgccaactctatacagataatccctggaaataaactggcaggatttaaatatgtggtctcttaccactataccacacttgcaatacactacaaatatttttcacaaatcctgtaattaccttgggaatggcccagttatatctcatcatacctttttgtgaaaaaagtattaatttattgaacataaaattgtacatattctaacattttggtaagtatatgcaaacatatataaattatattttaaaaataaatttaacttttattatatttggcttatattaacattaaaattattttagaattcctaagtatacttactaaatataaatgtaaagtatactaatgtatgctttagaattcctaagtaaattcctaagtatacttactagatgactgcagatagtcaaattagttccctgagacataaaaccattaggagtcataagctggctttacgaacataggttttactccacagtctatctgtagaaccagcactacacaacttggatatactaaatactttcattattcccacaggaaaatgaaaaaaaaaaagtaacatcatccacctatgccttacttttggaaaggtgtcaagagataactcagagtgttactaatgtttatcagttacctgcttatatgaaaattacaactattatagtagcaaaacagggagaaatggaaaagaaacatatatatatttatggatatatatatatatggatatagtgagtaaaagaaaaagacaaaacaaaaacttggtatagtatgattaactgtattctaaaacaaaatctaggaaatgccgtagatctaatcctgaaattaaatgagaattttcatgaatatatttatttaaaatgccttaatatatccttatacatgtactactttatgtttcatgtctactcaaaagaggaattgaagcatacttgcaattatttcaaaacatctgataattcagtttgtagaagaatctttgatatttctaaattgattactagtgcacatccaacacagcagctctacaactgctacttcaactgatttgataaagtgaaaaaccattcagtataggctactgtattctatagccaaagaccactaagcaaatgagaaaaatgtcttaagttagtatattagtttgctagggctgccttcataaaataccccaggctgagtggcttaaacaacagaaattcatttcctcaattctggaggccagaagtccaagatcaaggtgttggcagagttggtttcctctgaggggcataaggaaatgatttgctccaggcccctccccatggcttgcagatggccacctcctcactgtgtcttcacatggtctatcctctgtacatgtacattcctgaatggctgtgactctaaatttcctcttcttataaggacacaggtcagattggattagggatatcctaatgatctcattttaactctcctctctttaaaggccctatctccaaacatagtcaagttctgacatactgaggtttagggctttaacataggaatttatgagggaacagtacagcttgtaacagttagaaaacatttttgttcccttgaccagtcaataaaagcaacatcccacatggttgtcttctataactaaattattttatcataaatatttccaccaccaacaatgtaacctattaactacatcatataggcagatattggtaaaaaaaaaaaaaaagtgtcttttcataacattctaatattctactcctgatttgaaagaccaaataatatatcgtacacaaattatgaggccccaacctacaacctccacgacataatgattccaaccaatataatgttagctgtgttgttgactctgctgcaggggatataaaatgcaattaaactaataactaatactgattattcaaaatatgtatcaaactcactaacaaattgtaactggcatttttagaaggctatagcaacaaagaggttaacgtgtcttttggttatagcagataaatttgaaattttcaaacactataaattttccaggtggttgccacctggaaattaagtgttctaagtgctcacagtaggtgaataaaagataaacatttggtatttagtaagacatttatcataaaatgatggaaacgcatgagaaactggaaaccaggagacgtatttgagcagacaaatattagggtcaaatcaaggaattgctagctaaaaacatataaacagagtcttagaagcagaaagcatagtattaaatggaaaggatttaaaaatcaaatatatcagtgaatgctcttaatggtaaaatatggaaacagagaaatatggcaaaaattaaaaatgagttaacattgaatccactctgataatacactgaatattgatctcttctagaagcttaaatctattcacagctgtcccaggaataatccctggtctagagcagcagttcctaaagtataagaattcctggaaaacgtatgaatttatccttaaataaagagtagaatacacaaatttaggtgaggttcccagcaaaaagcaccaaagggaaggtgacatttacttttaagtttcttgatgaaggagaaaactagacaacattcttgccacagctgccacttcccatggatttaacttaggcaaaagccaccatgcagctctgcattgagatgctgaaggctatatagagatatgacaaatgagagaaaagatatccaaagaaggggagccaagcaggattttttcaagtaaacaaaatttggaaggagaggttaagggtgtaggaatcaaaagtcccattttgtggcataatatgattctgacacctttttgagatgctatggaaatagcaaaagctgttgtctatagaagtgtggatcttagaaggaaagtctgggatataaatttgtaagtctttaacataatggtggtattatgggaattgaaaacatcacctaaagagaagatctagggagaaaagaagagaagggttcaccattaggctagtgaaaagcacttttaaaaaagcaatgcatagacactgcacagaggaagaggagaaagtaaaggaaattgaccataggagggaagagccagctggggaagagctagatgggagtgagacagattgggtttcactaagacacagacactacacctgaaccaagagtaagacaagagcacagtttctgacacagtgtaatcactcaataaaggcttgttaagttagtgattggatgaatgagttacagactgaactagcacggtatttctagaattaagagttgactaggaaaggatggaaatacatggtggaattataactctaaaaaggtcagaccaaggtgatgttgtaaacttaccttagttttattttaatatactcaccaacaaaaaaaagtaagttttgtcatattttttactctttaataaaatttaataatgaaatagattattgggaagtaatcaataaaacctttatagattaattttaactgcttagacaaggaaaaatgtattgaaccttagaagtccaaaaagagagaaatattacaatggtatacagaaatacaataatgactaaaaatatttccactgaaatgcaacagaaaagttgtaagccattatatcttagaaaagaagcagtcctaatgaagtagatttttgaaaattgtcatacaggtaagctcattagttgcaatgaaagttctccctgctgatctaggagtacttaatgaccaggatttgttatgcctcaaaaacaaaggtactttttaattcatgtgatagctcactgaggaggtttcaaatctggaaacttttaaatgatgatatataacacgtgtataagagcattaaaatactccaaagcaaacacacttacctcattcaaaatattacattttctcctcaaatctcattaataaagtaatataataataaaaaagttatgcttaacaatcacctatactataaaaagtacttcagtgatggcttttctatgttaaagatgaagttggctgctccctgtgaaacatactaacggtgtctgctgacccatacacagacactagactccactcttaacagatggaaactaaaaagtcccaaaaccccagaacgccctgctgaaacacaaaaacaacaaaaagaaaaatacccagaagaaccaaaccaagttacagttctgcaagtccttatcaaaggtaaatatttttaaagaacaaattataatatcaataaagaattttaagtatgagtcaacataaatatttcaaaaacttcatttacagcaaaacctgctaaacaataaattctacaataaaaaatacatctactcaaccatgtttttccccaggaaaaaaactcccggtgtatttcaaggcactttgtacctaccatgttttcatccactactccgttatctatcaaactgattaatgtccatcaagaatactcatttccaatttttttttatcccatttggtcaaaaaatccaaaatatcagaattctctctttaggagagttgatttccctgaggtaaaagttattttgaatatcactgagtgattctgaatgtttacaacccattcagttcaatgcccttttgccctatctcaggtgatttaacacaagaaaataatttcaattattttcccttcttgaatcctattaaaacatctataactatatatatgggaagattcttcttatagcaaggacattttcaggttgcagaggggtaaagtgagtaattcaataattcattggaacactaggatttattagtgaaaatttaagtaaaaggcttattttttgtcttacaaatcaagacaggccatatgaaatatttacttcaaggaaacatacatctcagaacaaagtttcaaagaacatctcatccaatcacatgcttctttgtcaataaagttctataatcctcattttatagaagaagaacaatttaaagggagcaggaaaagataaaattaattttttttaaagaagaaatattcactctaatatggaaaacaataaaatatccttcaagttgatgaattccaatattaaaaagaaaataaagaggttataaagacaatttcatattactaatgactagtagtcaacaaaaaaagaatacagatattccagcattccagatgagttgttttccaaaatgtattcataaattggttgtttgacaccaagtaaagttgaaagaatcaatgtgaaatataaatgaaaattgaggccgggcgcggtggctcatgcctgtaatcccagcactttgggaggctgaggcaggcggatcaggaggtcaggagatcgagactatcctggctaacatggtgaaaccccgtctctactaaaaatataataaattatccaggcatggaggcgggtgcctgtagtcccagctactcaggaggctgaggcaggagaatggcatgaacctgggaggcggagcttgcagtgagccaagatcacgccactgcactccagcctgggcaacagagcgagactccatctcaaaaaaaggaaaaaaaagaaaaagaaaaagaaaattgaattattaaggtagtcaaaaaattatatttaaatcatattataaccaagtattaataatagctctatccgttctatgaccctttatgacctgatctaagcccacaattgagactagaatcaggttagaaatttgggcattaggaaagagtgaaatgaaactctggcagtatggtgtcttctataacaaaaaaagagagcaccaacaagttgggcagagatagatttggtactcaggtaagtagggagggacactgattgctggttctggtatcaggtatgtaataggctatcagtgcctatgaatgacattgaatcaagagagcatcaccctggccaaaaagtgcaggagatttagcagtagaaggtagggctagcaggtatctacaaggtttaaactgtaaaacaaagtattttataatataaggcctcatcatctaactaaacaaattaaactcatagctccaatcatgacaactcataatatcctacaactctctttatttttaaaatgagatattgggtatgaaaacactgtgagaaagtggaaagtacatacaaataaaaggtataattttcagtcttttagcactgaagatcagagccatgaaatgtttcttaaaaaggcacaaacctttactagctttgtctaaaggttccaaatcatccacaaaattcagtatatcagggtacttctcttcacatatttctaccaggaaatgaagtagcgttgttttctgatctgctgattttgtgtcctttagctaaatagaacaggagggagaaaaaacacagagtcataagtatgttgatattctgtctacttaaataatattaatactgtattttgtagataaggactaaaagttgtaaaattagttgatttcgtttttgaaaaacaaatatttaaatactcgaaaaactacttttgacttgctgcttggtgaaaatcattatttgtcgcaaaaaaggaataagtttaatcgagcatgcaatgttttatagaaaaaaatatggaaaatgcctaggaaaacagagtaacctatgagtctatttaatagtagtatttaaacatccttggcattcatccatttatcacttggcacatatccatagaatgcctactagctactgtagtagttggagacctaacaacaaataaaacatagactttcctcaagaagctgtttagttaaaaaatatacgtatttgccttggtgtgacaaatagtatagtaaaaataatcacaactttcatttaggaggacatgacaatggaactgagacttcaaagacaggaagttgtatgggcttagggaaaagaaagaaaaaatacaaaagtgcattaacacaggctcatggagcagcatttacaagggctatagatgaggaaggatatgacacctctgaggcagctgagtgactccagaattaaagtgtatctgtattagggaaggcatgtagggacatggcaaagatataaatctgaaaagaccaaaaaataaaaggaaagataatggcatgcaatggaagtaggattttgattttgaagcaatataagttttccaactagatgagagatgatcagatatacattttagaaagctccctccagtgagtgtggctaaaaagattagggcaagagtactaagagaagcatgaagagtgagttaaaaacccatggcaataatcaggcagggaaagagggcagtctgaatggaggttgtgcctgggaaatggggacaatgagaccatgtgggtgtggaaacccaggtgatgctgttaactaccatgtcagaaatgatgagaaacagatttgtgtgaggtggccaaagaagaaaattgttttggacaaggtaaatttgaagcttttcagtagtacccaggtggaaatgtcttgaaagaatatacatttatctatctatgtatagaacagtgctttcattattttttttcatgattgccccctaagaagtttttaggcatttttttcctaactgcacctataaaattttaaaatcacaaaggtgatgcatttatgtttatatactgtatgcatatctgtgttttacacctaaaaactggttaaacaagtaagacatttttgctctccaagaaccaactttttatccctgaaagatacctattgaaaatacatggttaaacctcagaggaataaactggggcaccaacttgtgacccctttcctcccaaagctaattagttgatcaaattaacataaacaggtatgtagaatgaatgaaaagaggttacgggcttgagacgaccagggtggaccaatcctaatctgaaatggccaaggagtgcaatcacagggagaggtagttaagctaaaacttcaacaatgataaaagttagcttgggttttgtgtagtgttgggatagaaagtattggcaaggaggagtggtatgaacacaggactaataggtaatctggtagcattccctaccattaagtaatcatttagagcagagatacaaataaagggttaaaaaaaaaatcagtcttttctaccagaatttaatttacagctggaaattcaaggcatacctaattgggcacagtactacttacttgcttcctttccaagaatttccaactttaaaattggctcctaaataaattcccataagtaatattttaaaaaatccaacctcactaaatattctatcactatcagaaaaataccaaataactgttaaagtccagtagtggaagaatgggagatttccgtaccatcagacatattaacatactgactacttattgattcaaaaactatcatagagccgggaacagtgagctacccacctagacagctttactttcacatcatgacacatgtaataggttcaaatgctatgctgacctacacaacatgcaacttatacagtggttcccagtactttaaaaacagactgaatatgaacacttagtccatgatttggtaccttgtttaaaagaaatacagatttcacaacatagagctgagtgttttacaagaggatgcctcaaaaacatgactccattgactacctagacaaatagtcactaacatacgtggatgatttggcaatgttaaaacatgtccttgactaattaatagtcttgagcacattactggaccttagctttcacacaggtaaaataagaaaatgaaacaacatagaaactctaaattcactttttactctaaaaatgttaagtatacattatagtggaactaagagttagtagacacagtacaatttaatttttaaaaactggaagagtggagaaatgtagtaataatctcatttcagagttatttctgtgtgtttgggtcagttggaatcattctatgggcttctgtttttacatatagactcatgaatgtcaaatacaatctttaagtttcgttacaatcctataatttcattcatactatcatcttaaataggtaaggccagattaaaagcagcaaacttttacaaacagttttctctttgcacagccaccaaaagttaacatgaaagttgtattctgttttgttaaaaagcaccctagtagcaaagatcctttatctcacccaccctcatttacagcaatgactacttggggaacactgttcctactctgaattctcggcaacccatttttactagtctacacccttgtagactgtttggaacgttaagacaatcaccatctaccttcacaatttgtaaagcctagaaagagtattccaatagtatctgtgatatagctaaacagccagcaactgctaggattaacgtatcaagaaatctcaatgacggaagaacaaccaactggattgctcttggtctttatttgtaagcaatgagaattcagaatttagaatcatggaaaacaatgtagtttgtagcaacttagtttaataaatgttaaatactcaagtcaaacacagattcgagttattcagagaccattataaagctaaacactgatttaggaggagggtgctaccatgggttgtcttgttgaaaacatcaactgagtagcaagcagcataatgggaacaatctagtattaaaaagtacactcactgaatagtaaagggaagcacaatattcctatcatttcaaaatgggtatttaacaattgaaagacaccactcaaactttcatgtaaataaatttgaaactaagcctaataaataagaggttcagaaaagaagcatgttgttgatcatgcatggtgtctcatttataaactactatgcagctctaaactccagggcagagattcttcatttatgctctaacattctctagaaaaatttcacaatgctgccaagatactcttcctgcctcaactactctattctctccctcccctctctctaaccatcttttaaaaagtcttccaaaagcatcaaagcataaaatgtattaggtccttatccatttgctcaatatttttttcatttcattaatgaaaattaccaactaaaaaggcacattctactcctactcatatcatactcactcatatcataatcagtttctgagctagaacaagtaaagcttggaatacagtgttaattttgttgaagatgagtaacaacttatgtaaactttgtaacgctaaatcttggaaagaaaataaaatatttgctttaaaaatatcttcaggttaaaagtatgctttatttaaactttaacagtcagtgcttgacaggatttcttttgtattactgtcaagagatttatcttactgatgagtaatcatcaccgttaaacagaatttcctatttatgtattgtttctttaaggtacatttaacgtggcataaatgtcaaataaacaaaagatggatggagtttctccaaccactctgttcattccagacaaaataatgttaaaagtggatcctgtaataaatcatggcctagttgtcagtctgcagtaaaactcccttgcagttacagtgcaaggtttggggatatttttgaggtattcagcacaaatctggatgacatttaaagaatattccatttatttagtcacatggtaataatttaaatttaaaccctaaaataaaaactaagcatcttcgtgatcttcagaagtcaaggaactggaatcccttcctgtttgaaataatgaaacttacatcttaagaatattatcacattaataactctactccgcatcattatgttcctataatctaggtatgtatcaaagcagcattgaatatttagatgtttagatgctgtggacattagtgaacaccagaaacaagacaaaattctgaaaaatcttgtaatggcaccattaccattttagaagaatacaacctgtgaataatattaatgctgaggatgacagtagcatcctcagcattaatgtttggtacttaccatgagacagacattagccaaataatataacacatgttaagtgcttaaaacattacaaccccaaactagtattatatccattatttaaaaaggaaaatggaaatttagagagatcatatagcttacactggatcacatggagccaatgattggaacacatgtctgtgtgaatacaaagctcttatccactataaaatatagttcctttacagcaatctttagtctagcttattattaacaaaataaaccaaattctcaaaaaatggcagtaaaacaacaaaagagcactaatgcaatgtaaaatactagcaccctttaacctgttaattctagcctggaaagcatctaaaaacagacaccacactcccttgaggtcatttctagttctaagagcacaacattctattgttttatctgtaaaataaataaaatgccatctgaatcttatcaatcaaatagcaactctttatatatttctaatggattactgctgacaaaatatcatatgattgaagaaaaaggtatctataaagtttaaccttcaatggatttataccactatattttaatagcatcatatcccatctcaaatcttttgcagaataaagtggattgtgtatgcataaaatagcatccctaaaaataaaggtatctacgtgaaaatgaatgtatgaagacatactaacaaagactataacacaattgctcagacagaaagctcaaaaagtcaatgtggtagtacaaattcactaataaaaccaaccaccattatagaatggattttgttttctggtatgtacgtgtgcttgtgtgtgtgcctggtgtgtgtttgtgtgtgtatttgagatgggctcttgctttatttacatatatatttatttatttatatatataaatatttttaaatatatattttaaataatcattgtgctaacaaaatttttcaaaacaaaactgagtatcactccaatacaaatggcaatgaaaatcttgaagtaaataaaacaagatggttgaggcaggagaactgcatgagcctgggagttcaagactgcagtgagctatataatctctccactgcgctccggcatagatgacagagtgagacctggctcttaaaaaaaacaacaaaacaaaacaagcctaaggtgcttatgccactgccataaccacaaccattaatattaaaatataactttcttaataattctaaagatagaaaccaattgatattatataaattagatactaaggcatataaatactaaattacttatggcacccatatataaaaacaatttatattaattacttaatattcattttaaaatgataatgaaaattaaaacattaagtgaccaagaaagtgcattaaataatgtggacttccgtaattataatatgctaccatatccccacacactttctctgaattatatttttaacacatttctcttgaattacagtgagtgtagaaacttctatatagaaagcatttgtgcattttagtaaaagtttagcatactacattatctactgcgttgcactgttctgttcatactgccccctttttcctgcaaaagatataaaacagctcaatgttccttacaaaaaaggactattttcagttcttttagtactgagagatcagaaaacagacattcataacaggcaaatgggaaaaagtactagaataaacaatctgcaagggaacaaatatgattagaatacaaatatattttttaaatgctaaactcggatgatcaaagacataaaaaagatacaagatactgcttcagcaactatatcagcactctccacctaacaaaaacactctcaccaagaacaagaagtcatggcagggtcgcagtgagactggcactttcatagtgccagtctatgaaagccactgcaggcatgcgcaaatcagtaaaacctccaggaaaatgatttagtaacatacgtcaaaaattttaaaaatattcttgtttggagtagtttcagaaaactcactggagtccaacattgtccagccaaagctatgtaactaaactgctattttagagcacggatttcttaatctaataataagaatttctcatgggaacaattaacaaaaattggagtaagtgcttagaaagtgaacatgtttagattgtttatacaaatggaccaaatacattaattttaaaggttttttaacccttattaataattaactttatattttagactttatattttagagcaattttagctttacaggaaaaactaacagaaaacagagttcctgtatacccttccctacacacacacaaattatcctgttgtaaacattttacattagtgtggtacatttgtgacaagtaatgtaccagtattgacacgttattgttaactagtttccacgttaaggttctttctttgtgttctgcagttctatgtgtcttgataaactcagtgttattcatccatcactacaatgttatacagaatagttttaccaccctaaaaaattctgtgtctcacctattcattccttccttcttccctctcctcagaacccctggcaaccactgatgttttattgtctctagacttttgccacttacagaacatcacatagttggaatcatacagtagatagcccttccagtctggtttctatcacttagcaatacgaatttaatgttcttccatgtcttccattggcttaaagagatcatttatttttaatattgaataatattccaaatgaatataccacagtttatccattcacctattgaaggacatattgcttgcttccaagttcaggtaattattaataaaatggctgtaaacatttgtatgcaggtttttgtgtggacttaagttttcaattcatttgggtaaacacttaggagtgtgattactggatggtttgttctacgtgtagctttgtaattgccagttatccaaagttgatgtgccacattttgctttcccactagcaatgaatgaaggttgtactatatacttaccagcacttggtgctgtcagtgtttagtattttagcaatgccagtacatatgcagtggtgtcttattgtttgagtttgcaattccttaatgacatctgctgctgactattatagggacagaaaaattacaactccatcctcttagggtccttgctggtctgataatttaatttgacatgagagagattaacaggagaaacgtgtaatgcaagttttccgtagcacaaaggccatcaaaggaatgaagactgaaagaaatagagtcagttacccatataccggattgtgaaaagaacagttgttaaggagcaactacattaggtgggaaattacttttaacaaggcctctaaaaaattctctttgtttcgactttttgttgttgacgattaaggatgttgcatctttccagtacggaaaggccatcttttgcatgaaaatgttaacttctgcttttaagaaatagcaaggaggtcaaagcaatctttctacacctgctgtttttcaagtatctttaaatagtcaatataccagaatagcatattttaatcccttcaatatcttttcatacatttacctgacacctatacgttttgatgggtatctcttcacatcttttgatcatttctttaaactgggttgtttatttcttagttttaagagtttttgtacattttagataaaagtcctttatcaggtatgtgttttggaaagattttcttccagcctgttttcttttcattgtcttaactgtttgccacagaagttttaaattttaataaagttcaatttatcaattttctttcatagattatacttttagtgttatatctaaaacgtcataataaaaccaaaggtcacatagattttctcttatcttctataaaatgtatagtcttgcaatttatatttaggtccatgataaatttttagttaatttttgtgaaagatattaggtctggcaactttttttttttttaaatgtagatgttctcgtaccttttctttaaaagaaagactattctttcactattgaattacctttgttcctttgtcaaaatcaactgactatatttatacgaatctatttctggggtctctattccagtccattattttaaaattatttttattttttttccctttggccaataccacaatattttccttattgcagctttatactaagtctggaagtcagggagtgtcagatttccaacttagttcttcttcttcagtattgtgttagctattctgggtcttttgcctccccatacaaactttgaaatcattttgtcaatatccataaaataacttgctggaactctcactggggctctattgaacccatagatcaagttgggaagaaacgacaccttaatagtactgagacatgctttctatgaacatgaaatgtctattactttattagatcttctttgatttttttcaaagttttgtaggtgttttttttttttttttaaatttgagatggagtttcactcttgttgcttaggctagagtgcaatggcacgatctcggctcaccacaacctccgcttcccaggttcaagcgactctcctgtctcagcctccctagtagctgggattacaagcatgtgccaccacgcctggctaattttgtatttttagtagagacggggtttctccatgttggtcaagctggtcttgaactcccgacctcaggtgatctgcccgcctcagcctcccaaagtgcttggattacaggcatgagccaccacgcctggccttgtagttttcctcatacagatcttatatgtattttgttagattaatacctatgtatggtttttgttactaagaaaatgatacactattttaaatttccaattccaattgttcattgctggcatacaggaaaccactggctttttaaattaggtgacctcataatctaaaactttgatataattgcttaacagttccaggaggtttattttttgtccattttttttgggggggggggtggcgggcattctacacagacaatcatttcatctatgaagaaagagttttgtttattctgccccaatctttatagcttttatttttcttgtcttactgtactagccaggacttccaacacaatgttcaagaggagtagtgagagaagacacacctgcattgcttccagttttagggaaaaagcatcttgttccttaccattaagtatgatgctagctgtcgattttatgtagatgttctttatcaacttgaggaagttcccctctacccctatttggtgagaatttttctcattaatgaatgttacattttttcaaatgcattttctgcatctattggtgagttttcttctttagctcattgatgatgatagattacattaatggattttcaaatgtcgcacccagccaggatgcatagaattaaaaattattccctctccttctatttacttgaacagatttagagaattgaaattatttcttccttacatgtttgatagaatttactggtgaaaccatctgagccttgttctttctgtttttgaaggttattcattattgattcaagtattttaatagattcagattatccatttcctctagtgtgacttttggtagatggcatctatcaaggtccatttcatctaggttatcacatttgtaggcttggttgtgttaataatattcttccgttatctttttaacatccataggatcagtaacgatagtccctctttcgtttttgatatgggcaatttgtatcttctctctttttctcttggttagcttggctattgatctttttaaagactcaatcagatattggtgggtttgattttctctattaattttctgtatcaatttcattgatatctgctctagtatatattagttctttgtcttacctactccagagtccatttgctcttctttttcttgtttcctaaggttaaagattattctttttagatctttcttattttctaatataggcacttgatgctataaatttccctgtgagcactgcttttattgcatcgaacaaaactttataagttgtattttcattttgctgtttcatataagtggatcaaacagaataattttaaatgagatggttttgtttttttaaaaaaatacagaaacttctgaactttacattaaaggacttaacaaaacacacgcctggtatatctcaggtgatatttttcagtttgttctggtggtggtggattctgtacctcccaatgctggaaccatagttcaaagccacttatgacacatttcttcatcatcctctcccctgtcccccaagaacaaatgttcataagtaccaatggctaagtattactatgtggataataatgttgcatgttttgtctctgattccaaaaatgtagaaacaatgcagacccttgataaaggagaggtaagacacttcttagagtatcaggaatggagtgtcttgtttctggtttttatttttcatttataaaatatataaaagtgaagtctgaattaaaccagggatggtaatattcaccttcggtgctatctctgatggggtagttgtctataagcctgacgccgaggaggattcagaggctgggtgtttgggggaaagggtagtttgatagagaagctatgcttgctatgagagcaggaagatgaaggcacacaagcagcctatttgctgagcctgagcaaagtcactccatcttttataattctattagaagaatcattctcatttacaacatttaacagcaattgaataacaaaggtgacatgaaaataatttaccaaaaacgctatttagaaaagccaattaaatatttcttagaaaatgtcatagattaaatgtgttaatgaatgagtcaaagggggttaagcattctaaatagtttcacattgctttggaaatcagtatttctgtgatttaactggctgcatgtaaaataagaatggcatttgttatttgcaagtctttggcccataactgctttactttcaaaggttgccaaaatttactggtataattttgccaacctaataaagaataaaaatccctctcaaaataccctgaatgcaaatggaacaatggatttgttcggcagagatctttcttaaaaataaattcatagagtaaaggaaaaagtgatacatagggatcaaaacttcacaaaaacgactcacagtgttaacttgtgtgagtgtgacaggtatgcaaaatacaaactgcctgaaataggcaaaggtatcctgtctcatgcttttgtagtcactgaaactctacctgtacaagctagagacttgtaaaatggctcgagaaacaggccttcaacttatttcagttccactatgtgcctgaaattcacactccttttcaaagttttcattttcagagtaatgtttagcttggcatgagaggaaaagcagcaatttttgaaaatattttcaccactttttcttttttttttttttttttcactctttttacccaggctggagtgcagtggcatgatctcggctcactgcaacctccgcctcccgggttcaagcgattctcctgcctcagcctcacgaatagagtagctgggattacaggcgcctgccactatgcccagataagttttgtagttttagtagagacagggtttctctatgttggccaggctggtctcaaactcctgacctcaggtgataggcccgcctcagcctcgcaaagtgctgggattacaggcatgagccactgcgcctggcctcaccactcattcttaagtgaagaagtaaagttgtttcgtttttgtcgtggctttggtgttggttaattttcattttttcatgtttgcttttggttccagatcaccagtcagggattttccattctgggatatgaaagtagggcagaagaccaagcgattcacatttcaagttgagtatgaaaatcacctaggaagtagctttaaaaatgccaccaatcaggatccacatccattctttctaagttaattgaactggtgtggggactgcggcatcagtatttcttaaagggtactccaggttgctaatcaatgtcatccaaaagccatttgtcacaattttggaaagtgtctcattagggttggtggaaacattaaagaatatgagaatttaatgtttgttgctgtttctattgttttaattatctccatcacagctctgatgaagttattctactttttctactttttgcttataaaaggaatatccagaatcagataaaaaattcatgcattagaaaagagaatttaggaaaaattaattttgcctgccaccccctcaccgtcttagcacctactcctcaacgcccatagccccattaccatgtattcatcaatgacttcaactctgagacgaactcattagatattctactgccatagaaaacagaaggcttcctacaaagtgacagtatggataaatttaaagtgggatcaatagttatttgtttctgcaattttcccaaagaataacagcataaataccaataaaaattagttattacacgtggtaaaactccttcaaaacttatatctattaccccaatataggaagtcagttgattcaatcaatcacctggaacaaagagctgcatcatcctgttgtattgatcagaatgatctgttactcagaaattatacatcttattagacattagtaaacattattaaacacatgttatggttattatatgtggattagtaacatcttcttaaatttacaagtcaaaattatctcatatattttaatatggtgttgaactttgatggttgggtcaattcactctttacctaaaatcctttgaaaaaaatgaacttggccctatcaacgtgtctcttggagaaacatctttgatactaaccagatacaaacttttctaggtcagcattttggtcagataagcatctaccatctgccgatttaatttctaaagatatgttttccacttaatcaacagcagtctccccactctcaaaattaatatgatgtcaaaatgatatccattttttatctgaagttcagtactacatttggaggattttttaatgacaagcagtcctccattatttctgcaaggtttatccttttaaaaagtcaagccatcagaaagcaaggtacttacaccattttaactaaactagaagtagcattactgtgactgaaacgtacattttttttcacatcataagggttcgcatggggtgccaggtccttaagaggcccagaatacatattttgggggagaggggaagagaggaggagaaagagagattgttctaaaaaaaaaatcctgacgaaactgactcatttgttgtttataacactattcaacacgttttccttttgtaaagatacatatgcaaaatttcttatgaaggtttaatcagggaaaacactatttttgctcatgaagtgaagtttgcacatcactttgaccaccaaaaagtcaagcacctatatagcaactttaatttttatttagatcttaatcataaattcagttatgtttaccttatatgtcatattttacttttttgtcatatgtcacatgaaatctttgggatataagaaagcaaatccttttctctcgaatccagagatattatagttactcattgccatcctgactacaaatgtctacaaagctatgatacagctccccaaactaaactataatgggcatgaaactcaagtattcatgctcttatttctaaacaatgcaaagttaatttaatatgaattttcatgaatttttcatacttgagttaaattcgtaaagggcatttaaaagtaaggattttggatataaaatgttaaatgtcatataattacccagcatgttttaacagattaaaatacttccttgtctttctactgtcaaatatatatggaattccttgtgtagaagcttatcatcaaaccaaatgctttatactcagtgtgaaaattcaatcacaattgtcaaagatcaagctgctacttctgataacaaatatgatgagatatcatcttgttcaatatatgctttcaacttgacatgtaggctaataaaaaacatgaagttgtagtatttattttgtttcttccacaacagaaggctcctaagagggatgatcaaaatactcagtatcattgcaagaaaataaagtcaactctttatctgcagacagattaactggtttgccgactaactgtagtaaaagaataacagctacattgcatttgtaaaagatttaaaaattactatgcatcagtgattgtatctcaatgagaggatgtctatttattttcaacaacaaaataaacataagacactactttttgtcttatgacaagtttcattcattcaacagctatttattgagtacttactatataccaaccactgcagtaggctatcctacctcattaatcacacctagtctccctgtcaacagctctccttagaggaaggcataaggacatgaggaagagcatgcagccagtttttttgtgtcaactataattctgagatgtaaaacctaaagaggatcacagacacttttgcacgaggaaacagactgtagtacatgtgtggctgtggattaactttcccctatcttgcccctcaccctgtttttcttactttgccttccttctcagggaaagcctgaatctgccattcttgcttgcctccttctccttcagcttccaagttcataaccagcacaccttgacaactcctcagatgtccctgaatttgtgtacttccctacatccccactacattctacctcaaacccttctgccgttaccttagcttggaactccatcatctcaaaacacagtgatagctacttagtggacactcaaacctttgctaaataattgaataaggtagcttcaatcatatgccctttaagatactgaggtaaacaagagtagaataacaacaaaaaacccctgatctcattctcttttgagcaaccacttcaaacatgccagtagcaatatctcccattagttgcctaaggtagatacttaggaattatttttgacctttctctcttctctgccacccccataccatctttcctattaccttctcagtttggtttcctctgttgctctcttaggtctcacactacatgtcaaccaaacaccaaatacctcctcaatgtaaccctctaacccagcgctgtccaataactttatgcaatgatggtaatgtgccatatatatgctgccaacgggtatggacactgagcacttggcatgtggcgagtgtgactgaggaactatgtttttaattttatttaaatttcaactaatttgaattaagtagccatatatgtttcatggcaacagtactaaacagtgcagcttaaccttcttccatactgctgatagacatatcttgctacgaaacatctgatcatattacttgccttacagagtgtgactccataaaatctccatcattaggcaggatattcaaagctctttacaatctagaccaatttatcacctcagtctcattagccccactcctttcccatctagtttgcaaaggtagtaggccactcactgtactcacacatgccatgctataacccttttggaagctgctgactcctgcttagaacgccttttcctctcacagaacatctgctcatccttcaagatccagcttaaattcccatttctctctgaatatctaactgccctctcatagctgagctaggctctctgtcttaactctgctgccataacttttagtatgtggcttcattaaagcatttcatcataattaatggtttacatgtggaaaatatgagtctcatgtatgccaggtaaatattaatcacatacattaaagatagaatctaaagatagaatctggcaaagcatctggcacaggacttcactctgagtaagcccacgagagatgtgccaagtcttcaggatgtgttttaggaattgcatcgcccatgctagggatcttcaccaaatacagctgcctaagaaaacagagaggaaaataaaagaatggagatggggcaaaggaaacactcacaaggcattgatagcaatgagaggcttaggccagggaaattgtataagaaaattcatgaaagccccaatagaataagcatgcagtaaacctataggtaaagcagaacttgtttttcaccttccctaactagctggcaatagcaataatcaaattccttaatcagggagtgtggttgttacgaggtcaagaacaagaaaaaggttttcttctgatgtgtaactgagaagaatttgttgtaagcagatcaataaagccctattactatggcccactcctcaggaaagagctctgttttataaaacattgaatatatttgctgtaaggaaattcaacctatgaaagacacaggagaaaaaaaaggctctaaacttactccattttcatgtcctctagaattatatttagatagaaacacttcaaaatcaataatatccgagttgcatatatttccaatataataatttcccctttatataaaggggtcccatttttctctcctttcagtctgcttatgaaagcaatgcagagaaatatttaaatagttaaaggtaaaaatgttaatggcaatcctaagcaatattcaatatatatacaggtatctgaactgagtaagtacgagtcagtattaataatattttgacgttccatttcattggtttgagaaagcataggtttatgatataattttgttattaaataaaatccttgaattggatttgcagattgaagaaaattaatatttggatttagttcagaggttgagtaaattagctcagttcactctgggtttgagttcatggttcagttcaagttcttgataatgagcacatcaaaataaaaaaatatttaaataatgcaatcagggctgacatttaagagcaagtgttcaggcaaatatgtgtttttaaaaaaacaaactcactttacagagagagctaaggttaaatccgaaggtttgagcattccgggagccagcattcatgtagtttcccattagcaatacaagttccagcaacttgctaaagcttttgctcttctttatctcttcgcaggcagtactgacagccatgatgtcaggtttgatgttgttcacctgctcttcaaactgaagcttaaagagaatagcactgagccgtggccgtagtctcttcacattgctcatctgattgaaaagaaaacagcagatttcctttaaaatgcatggtatagtttagtactgtacgactgcaagtaatctgggatgatttattggtatgacagtaccaaagaagaaatatgtctcctaaaactgatagcaggaagagagaaaagccctgcttgtttttgtaaggaatccagagtcatccctcaaaacccaaattaacaatttagatgctcaatgaaaagaaagctttaattaaatgataatgtttaattaagcaataaagtaagcattttttaaactaaattctaaaaaggtaacaagatacataggccacaaattacaaggcattcatgtcattattttgaataatttttgttcaatactgcaatatactgggtcatgtttaaaacacattcagaaaagtctaaagagggtttgttttcttcaaatagcaattgctgtcctcagaaaccctgctgactaacagtatgtgttagatagagggagagtaaataggtcccaatttgtactaaattgactttcttcagaaacacaggaaagtagaatgactcctgacacatactaaattagcagaatcagagttaggaaacatgggagtagtagcaggcagaagcggtgcaaacccacaaatctatcacatgccaagttaaccctgtctgggactctaggtttctctactgggaatgtgggggactggaggtgtctaaaagaacaaaggggcaagttcctgcctttatccttactcctgtgttatatcaacacacatgcaggaaataatcacttagctgtaggctgaagacataccacatatgaagctagatatgaattccttgaccaaacacactagggatttgggacttaaaacgcactgaaggggcggtaatagtaaaattgttgaacttcaacaactattgtaaatatcaaaagcaggttaaggcaaggtcagaaaaaaagcagtgacagattaaaatagggactgtttctcccttagtcacagactgtaaaggaaaggctaaaaaacaatgctatatgaagcctgtaggatgccaaatataatgaaaatcatgattgtttgggatacagaaagctatcagctcataatataataatgaccgttacttaaaatatactagacaaaggcttataagactccaatatattatagacactgccttaatgactaaacataactcagcttactcatctgacaaaaattgagcaataaagaattagttctttgtacacaactctgagagaatattttcatatagaccaaagccctatagtgaatgaaaagttccattttcaaataatataaatatctaatttatacttagctttctccccagacccttgccaaattaaatggttattcatatacaatcaagattctaagggctcaattaatgtagttattaataagaagtctactttacaaggcactttaaggaacgtcttcatattccactgtctaggaaaaacaaagaatgtaagttcaacaaggaccaaaaaaaaaaaaaaaaaaagaagaagaagaaatatcattaagtttatagagtaagtttaagcgatatgaaattataaagagacaaagatgtactattataatgttgattcttattgggcatgaattgttctttttaagcagtgatcacttatcacaaagacatttgtcttaaaatatattatattttaagacagatgggttcacttacctggattttttttatccttaaccattgcaaaaggaagatgttcatatgacactggtaacatgaataatgctctattacacttaatatgtcctttagagcagtcagacatacaaaagagcactcacatgtagtacctgtagttatggccattctgaaggtgtataatgggctcatagcatcgctgttttcagtaagtgccattattcatgattatgaagccaggtacttgcaatacatatgagaagaaattctccagtattctatgcaaaacatttgtattacgaaatatattaattctaacatatattaatgtactactacattcatgcacagaagaaaaaagagactgcttaaatgcctacattataccaccccaaaatatgttaaagctttcctgctgacaagctaaccatatgtagccagcatagagtaattaattctcctagaaaaatataacctagatttgtatgaataatgagtgtatctggcactagggacaggtaccttgaaaagatagagtaagtctatgatgtaatgcagaacaaagtgctacaagttcatgaaaatccctgacaaggcaaagtcaggaaatgtaacctaaaaacaaagctttgaacaacacttaaaaaaaaaattagatgtccttttcctattgttctttcttccaagtttagataaatcagtatttgactattattgagtaaatgtgttttaataaataaaattattgagtgggaaaagaacttgaaaggtcacctggagaaggtgcctgtctttagttcactatttagtcatatgatgacccctaggccaaatggttgccctttttatttaacaacaaaatatcatttaaggttaatgttccaagatctaaatcatggaatctatgataataacagaagggttacttttctttttttgaggcagagtctcactctgtcacccaggctggagtgcagtggcacaatctcagctcactgcaacctctacctcctgggttcaagcaattctcctgcctcggcctcttgagtggctgggattacagccatgagccaccacgcccggctaattttttgtatttttagtagagacagtgtttcaccatgttgttcaggctggtctctaacttctgacctcaagtgatccacccacttgggcttcccaaagtgctgggattacaagcatgagccactgcgcccagcccttttcctcattatttgaatcaaactttatttcttcaggtggaatcaaataaaaagggttaagaagggggaaaatatatgtatatgtaaaaagcccgaccaatgtttccgcatcctcaccacttctcatattctatcaacactggggatttgcattctgttttcctgctaagaaaactaaacttctgacttgtctaagactaagtggaaggcagaaatgaactatggtgctcaaataatactctgaatggcaacagaaagtcatttttaaaaatgagaaaaaggaaagggtaaatgaacaataaacataaaatgtaagctagttaataattagaatgctagaagaaattagaatttcatttttacagttatcctttaaatctattgttacaaagtcttggcaatataaattcacgaaacccaaatctgacaataatgagatgtaatctgaagatcaatccaaaaaaggaaaaatacattgatttcactcctgtttttcctgaaggcagggagcagtactcctgtaacccccccacacacagatgtcatatgtcagaatgaagagatgttaaaagcagtgactggtaaaaatcaagaagcaatatccagaaccctaagggtaattttatttcaaaattttgtttgttggcaatatatgttgttagagagggaacaacgtaaaaagacctttagaaaaatcaatgaactaacaagtattgactgggccccattcagtgctgtgaggggcacaggagccatagcagctgcccctgtagcccttatcgttgaattctttctgcctgtcttaaggagtataaagtcagaaaggtccccaggaagatgtaatctctcaaaatctcattatggttctatttttcacatataattttatccattattctataaggaaaaaaatcattttttacatcaactttgtttaacaccatatctacttctctttatacattttcttttataaatacaggttgtcagatgtttttttcccccgtcctactatgcagacttaacatggcacacctcagaaggatttattttttattcttttttattcttccctgaagttattatgaaacttcactgttcacttaactctctaacagtatagtaacctgctgactgggaagttactggcctcggtcttaatttataatactctaaaagcattagttcatctactttgtagatatcacattataagaaataacagaaaagcatttcaggaaggtgaaatgactctttcaagtcacctggctagtaggacccaggcctagagctaacttgctgctaatcaactgtccttaccactcagagcatcgcaatgtggaaattaagaaccacaatttacaaaccatctggaactcaagcttcctctgctatgttttctagtaggtaagaatgaactttaatttcttcacagtagttatcaagtaacaccctgcaatgagctctgcctgccacctgtactatctcaatatttcttaccttcctccttaatatacccaactacctcctattgtgctgaatctttaatactttttcagatctacttttgttgtctctccacatcagggatcccacaccagtaactgttagaaaacaggctgcatagtaggaggtgagcagcgggcctgagcgagcaggtgaagcttcatctgtatttatagctgctccctattgcttgcattaccacctgagcttgacctcctgtgagatcagtagtgacattagattctcataggagcgagaaccctgttgtgaactatgcacgcaaaagatctaggttgcatgctccttatgagaatctaatgcctggatgatctgtcgctgtctcctatcaccctcagatgggtccatttagttgcaggaaaacaagctcagggctcccactgattctacattatggtgagttgtataattatttcattatatagtacaatgtaataatagaaataaatgcacaataaatgtaatatggttgaatcatcccaaaaccatccccctgccatctatgaaaaaagtgtcttccatgaaaccattcactggtgctaaaaaggttgaggactgctgctccacactacactctccactcatactctcctattagctaattcttcagttctctatgggagaggtatgataagcaagaagaatgtgaaaaaacaaatgcagttttatgaaagacaagagaaaatactttgagaaagtaatgtgatctaatacatcacagaattaagacactagagaaaaaatttttgagcttgatttttctaatgatataaaaaatatctttcattgttaacagaccaatatgttcatgatctccagaattctcagaaaaaaacacaagttcatttcacttggagaaaggcttcaaaaaaaaaaaaaaagctattcaagtgacttatgcctgaggtaatactcagaatatcaaaactgtttttaaaataaatgtactcttacgatattaaagctgctatgctaaagttatttaagaaaactatacaaaaacaaagtacatatggtataatttttacatatttcataggagaaaggtaaagccaaggcttgtacaaaaatattaaaaggctaaaatgtatattcctccacttagtcaagaaataaacaattggctatagacattagagactgctgcacctttgtttataaatccttatcaattctggatcactaaggatttcacaggaggtccaaatgagttctgaagatactcaggatcatcaagtggtaaagctatgattggtaaagctaaagaacaaagagacttcctatttaatttggcagtctcagcacacagtcttaacacataagtttcatatctcttgaattaaaaagctggcataaaccccagaatcatattagtgtcttaaattcattcatgcccgcttccagacaatccccatcccatcgtagaaaaccagtgttttgatttcaatcactatagcttagttttgcctgttcttgaaatttatattaatgaaactatacggtaaacagtttatatagctggcttctttcactaaaaaaaaaaaaaaaaaaaaaagactgagatttatacacacgttgtataattcagtactttgttcctttttattaatagatttccatgcaagaatataccaaaatttgtgtatctactttcctgctgatggactttccccccaacccaccccagtttggagctatgtagtgagttgaattgaacagagacccacaaaaggtatgtctaaatcctaacctctgctaccttgaatgtgatcatatttggaaacagttttagcatacgtaattaaattaagaatctcaagatgaaatcatcctggatttagggtgagccctagactggagtgatacatctacccagaaacgccaaggatcgtgagtagattaatgaagctagcagagtggtatggatcagattctcactcagagactctggaagaaaggaaccctaccaatgccttcatttatgacttctggaccccagaaatgtgatagcataaatctctgttgttttaagccaccaagatcgtagacatttgtggcggcaaccctaagaaactaatacaggctattttaatactttcgtatgagtgttttcatttctattaaattagtaaaaaatatagtacaaatgtatacctaacctaaaacattgccaaagtgtttttgcaaagtaggttatatgattttatattccttttaccaacttatgttttattctagttatcttttatcttttcatgtttaggtccgtactccattcctctaattattcagtaaggtgtgatgcaggagttgagattcattttagtccctaagatgtatagactttacaaaactatttgatacaaagaacatcattgaatatcaaatgatggtatttttgtgggtctatttctaaccttctagaaagcttagttgtatatccttaagccaaaacttttgccttgatgttaaatcagtagtttaggtccaccaagtttgttgttctttaaaattggttttctatattctatgtcctttgcataccatatgaattttagaaatcatttgtcaatttctataataaaacctgctgagattttgattgggaatgtgtgaaattcctaggtcatgtgagggagaaatgaaatcttaacaataccaactcttccagtctataagcataataaataccatttctttacaacttctttcatttctctcagcaatatcttacagttttcagtagaaaatctgcacatatttagtgaaatgtatcccaaagtatttttagttttttttatgacattgtaaataatactattttaattacatttaaatttttgctgtttgtagaaaaaaataactatttttggtacactgactgtattctatgacctttttcaattcacatagacaattaggtcagctgaaaaaaagaaaaagatggtatactttctttcctctaatgtattcatcttttatgttttcttgttacacagactagtacattataatgctgaaaggaagtaatgcaaatagacacctttaccaggttctcaaccataaaagacaagtcatctaatcattcacccttaagttgagtataactccaggtttctcatggatgtcctttatcaaaatgaggaagtttccttctatttctagtttgttgagttttttcataaaaaatgactgaattctgtcaaatgcgtcttatttcgcatgtatttaggtaattatgatttttctcataattaccttgtatttttttatctgataatatggctaactaattaattttgaaatgtaaaaccaaccctgcattcctgggatcaattccatgtggtcataacatactctccttattaagttcagcaatatttgatgcaaaaatattttgttgacaacttttgcatctatgttcatatatgatattagtttctagttttgctgtagtagattcccttctttgattcctgataccagtagtttgagaatttggttgtctttttcagcgcttcattttcatttggctcaaaataattccttctttggcccaccggtaattttaaattaggttatgcaatttttagactgtggtagatgttctattattgttgttgtctaacttaattctgttatagacagaaaacataccctgcaagatatctatattttgaaaattactgaggcttattttatattcccatatggtctaccttggtaaacatttgatatgcgtttaaaaataatgtgtattttgcagttgttgtagatagtgttctataaatatcagaacaagttggatgatagaagtatcttgattttctaagaatttactgattttttttgtacactttttctagaatttattcaaagaggagtgttaaagtctcattatgattgagaatttgtatatttttccatttttttctgccaggttttgcttcataaattttgatgctcaatttttaggcatacatatttaaaatgattatctcttcctggcaagttattatttttgttattgtatactgatacttcatttcttataatatagtttgccttgaaagataccttcttggaaatacacatacccatgatatttttcatgtgctattttattactatttgttttccatatgtcctttctgcctttttccccactgctatgtttgagtgtttgtgtcccaccaaacataaatgttgagaacttactcaccagtgtgataggattatgacatggggcctttgggggtgattggatcatgagggcagagtcctcatgaatgggattagcaccctcataaaagagggtccagagagctgccttgtccctccaccatctcagaacacagatagaaggcaacatatatgaatcagaaataagtgggccctcaccagaaatggagtcggccagcaccctgatcatggaagtcccggcttccagaactgtgaaaaataaatttcagttgtttataatccattcagtttacagtattttgttacagcagccaaaatagaccaagacaacctcttttatcccttttctgctttgtgttagtcaagcaatttttagtattctatttcgtctactggcttaactatgcctctttttatattttctctggtttgtctaggattaatacatcttaatgtatcaatctaattggaattataaaccctgttacgcaatgttttttattacaaattttctttcaaaaaatcataagaaaaaaggttttatttactatttcaggtactcttcattactttttgtagatctgagtttccatctggcatatttcccttttgcctgaaggacaacttttagcatttcttgtagggtaggaattactgtcacaaactctttcagcttttataatactaaaaatgtcttcatgtcaccttatttttttttaagacatccattagatagagaattctgagtttacagggtatttttttaacacctttctgttgagcttcttgcattttaaactcttctgttgacttctgctgtctattacttctatgaagccagcaaaatcttttatctttgttttcctacatgtactgtgccttttatctttttcctcccctcaagatacttttatcattttctctttttctttggttttccacagttttactaggctgtgccatgatatctttttctctttatatttttcctagttgggatctgctgagcctcttaaaccctaagtttatgtttttcactgaatgagacttttttgtccattatttcttcaaatattttgtcagccacaatcttactctcttatcctttggggactccagttacaggtattttagactgaatgatatctacccaataatacctgctgtttattactttattcagtctttcttcctacataactaagagaaaataatcactataaaactgccttcgaatttcactgactcctctgccatctccaatatactattaaacccacatactaaaatttttaatttagttattgaacttttcaataatttctatatagcaattttttttatagttttcatttccctgcaaatattccttaattatgaccatgtttttctttaattctttgaagatcatttgctttagttctttgaacatatttgtagtatccttattttgtctttgcaagtgaaatccaaaacctgggccattttggacttctttttttcttgataatacatcccattttattattctttaatttttaattcaatattgcattcaatattgaatacttacttacatataaccactctcagttctgtaatatcccattgaaaactatttgttcttatttgagcagtcaaatcaatcactgggtgatcatcttaagttgtatagttcactataaactttgttagtgtagctctctggaaagtaagatttgttttcttagaccctctaacttagtgaaactcaatctccaacctgttttccctggggagttcatcaagacgtgctataggttttattagggtgggtctagactaggtctttagggtgtggccctacttcctaaagcaccagcttttccttatttgattgaatgtcaaatatgctaatgaagtgttaagatgatctctgtaatttggcagagccagaagtacaaagctgaacctctagtatctctgttccactctcaccctgtagcagctgctatctggctagtcttgctcagtgtatgaacactccagctcccaggcacagacacaagggagatacccacgtggactactggagttcctttctgcacaattccttccccattagtgctctgccctgtagataccagctgtttcactgccataaattctgatctttgcctcctcagctcagagaactatattctctgctagaactcaaatctctgtaatttaagtggaaaactgtcaccaagccaaaggctgagtattcatgaaacttttaagtttctgttctctcaagaactgcagcttttctctactggctgctcactgtctgaaaacagttgacctggatattttgtccagttttatcaccgttagcagtttatatatgttttgttatatgtattcctaagcattttttaagttttctgatgttgatgtcaacgtaatttttacaactttttactataatttccgtttttaaaatacaaaaaaaaaaatcctgtacccaaattaaacatgctgtccacatactgcttcacttaattcatcatattctttctctcttcttctccacatatatacatatatgtatgtatatatgtatgtatgtataaggtgctctccacaagtttttccaatgttaaattactgtttctttcctttataattaatagtttatggggagctgtttcgaggctatgtaaatagtatgtatataacctattttcaccaaattttcacatttgtatcaacagagatagcacactaactagaaaaatacagaatctactcaactttattaaaactgaactttacggaccctttcagaaacagcagtaccttcaagagcatgacataaaagtgcaaatgaaccagaatatatctacaataatttcactttaagccacaactgcaacaaaattgtctaacttcagtgatttagttccataagtccagcctcctcttttccattatgtttccaaaatagtcttacaagagtataggtaaagcaaatctcaaacctcataatgagatttgaagagtacagaaaaatgattcctaggcactagatgaaagtcagatctaaaagcaaccttaaaacaatgttgtttgcaaagtgatgaatcacaagagacctttttgcttataactacaaaatgctttaggctgtatttcaaatgaatgatgcatggctggtaattagtatgtgactataatgatgttttgttttgtttttccaaatgaaagaaattaagcagattgtgccataaaatttcaacactacatagatggtctaactagaaagcatcatgtttccataccaaaaaaaccccaaaaattatcatcaaaaaaaaaaaacaatctacaattctatgataaaataaaatgcccccactttttagcaggaatttagtggggaagtggggattttagattttaaatcccatataagaaaaagcagaaactaagaaaattttgaaaaacgtactttgaattagccatcaattcaagttcctgcttaaatattctaggtaattttttacctcgaagttaatcttcagctattaaaaataaattgcagaagcatttaaacagggaaaccactgctaaaagcaactttaagtacagtaggtacctatagcaaacagaaacacaagagtgattgccaccataagaaatgaagtatggccttagtgtcaaaaaagcatggttcatagctgagctgtaatagttaccggttgagtaaacaggtcaaaaagttgcctaatctatgtgatggtaatgcctatttctgcagttatatgaaaatgagacttaactttactcattcattgtgtatcaaatatttattgaacccttatttatgtgtcaaacactgatttaggacctgaagattcatattaaacaaacaaacaaacaagcaacaacaacaacaacaaaacaagaacctggtgcacatggaatataccataagtaagcagagggagaaggggagaaaaagagatagaaaaacaacaaacaaatcagatcattttaaacaaaaataaacgctataaataaatgaaaaagagggtaacatagatagagaatgatggggggcagcatcattataatgaaaacttctataaggaagtggcatttgggcccaagaggaaacagcaagaggaaaacctaaaatgagaacaagaaaatgtatatagctcaaacagtggaaaaggacaagggtagtaaaagttgggattaaagaaacagagactacattatcttataaattatcatgaaactggaaaccattagaagggtcaaagaaaaaactgaaagaattcattggcactaaaagaaatgttaaaagcatttcttcaggaagaaaggaagtgatttcagatagaagtctagatttataaaatgatgtgaataacactggaaatggtatataggtaagtagatataaaagactctttttaaaaaataaaaagacttaaaatttctttcaaaaagaaatactccaagtcctaaagcaccaataatatagcaaaacaaagaataagagtgaataagtcaaaaaagataacacagactcattaaaaatactcaatccaaaagaaggtagaaaaagagtagcaaagaatagatgagataaatagaaaataaatagtaagatgctagatttaaaccctgccatatgaataaccagattaaattaaaatggtctaaacacttcaattaaaaggcagaaatggtcagactggattaaaaagcaaaactcaatagactgcctataaaaactgtaggttaaaagataaaggatagaaaaaggcatagcatgcaatcactaatcaaaataaagctgaagtggctatattaagataacacaaagtaagtttcagaaaccattagagtatttgaagtttgtgaacgacataaaatctcatttaataacaagagtcagtagctgctatgtgaaaatagtatattcaaaacatgaagcacaggtcctgaaacagtaaataacaaatggcaaatacaaaaatacatatggtatgatgaaccgccatagcatcagcatctctaacattacatcttttctcaacaatattgttctaagattaataaccatattttattctactttaaatgtggctttccattgccatttcattaacatttatgaaacaaacacactataagcatggcaacccctgccgtactttcagaattttatttaacaaaagagggattatgagaattcattaaaatactataaatgtgatacttacattctagagtcacttggctaaatcctctgaacttgcaagtggttaattaactacatgttcaagattgatcagtggaccaggtaaaggtcagttagtcacagagtaaaagggaaagctggagctggggaggtaggatccaaacaaaacacaatgcagtcagatccctgaatgcaattccagccagctaatggttttatatctatctttaaaagcagacataaccagtagacattaaagttcttggtggtcttctagggaggcagggtcaggggtagagatacagacagtgtgacacaggaaaaagccctctatgttgcagattagtttattcaaaaataatgaacaagagaacctttttctatgatatttgctaaccagctcatatttcgaacaataactctgcccacatactcttaaatgactaattccttgccttaagtttaatctatgcgattttacaattcttgttttttgctgatgccaggatattaatgacaaaagtgtttctctatattccaaacataaacccattaagaacgacagcttgctgtgtttcttagtattgattgtatgcaatttttattctttgtttctacgttaggacaagtaaaattcattcagggacttctaaaaataaattggtagcctttcaataattcatctggtatttgggttatgctttatttcaagccattgatttggtgggtgcattttgggagcattcagatcaaatcactgtgatacattttttttcaggcaactcctctgcccttcagtaataaagtatacccgttgctattgtctgaggatatcagaagggccaggtctgtgatctgcaatttaagcagaatgggagatactaaaatgtgggaagacaaaggaaaacctactgaagatgggacatcaggtggcattcaggtaacggacataataaaggatgaggctataattaaggctcgtgggcataaaaaaaataggcagaaacctgcgttttaggaagtacaggttgaggaaacagtggtctctaactgctaagagagatcattaatgaggccagcagtcaaaatcatggataattccaaaggaagtggtaataagaattcagtaagaagtagctaagaccacagcagacatagtccttcccaggagaaaaaaaaaagaaagagagaagaaaaggaaagaagtctcccctgcccccccacccctcaaaagcacataaatagaatgagaatagaacagacaattgagcagtaaagaaaaagattgtcatgaagctaattgaactagttttctcttaattacattaaaaatatgaaatgtttttggaaattctgggtcagaacttaggaaaaacaaatacagtgtcaaggaaacttataacaatattaagctgctggaaccttaaatcttttcagaaaatactagcattcaagtgatcagaatgatttaggcactttactgtggctagtgattccaaggagagctacttaaaaaggaaacattgataaaatagggtagaaagactccatttgtccaaaacataaaacttcagtaatgccacatagcttaccataagaagatgacacataatgctacaacaaggaacaaaatattgacagaataaaaactgacctaatgacagtttcagcataaagccacaaactgagaacccttaaacaaattaaaatttatattactaagttttgactatttaatgcataaatgtaagtcaatatactgtaagtgggacagtataaacacaaaaaaaggaatttcctaacatataacaatttgaacaaattcctagattttccttggacaaatatagtaaatcaaattatttggtagtggtgatgctggtggcatataagttagtgctagtgtttcactaaacgggaaaaaatcactttggctattcggtatccgctcttctaaataactgtaatatctagacttggatataaaattggcatccttggaaaagaaagaaaaatagcagtaatggaaaatagcagacttgcaggataggaaacttgatccaatgttaaaggaaaaaaaaaaaaacaaaaaaaaaacacatttatcttgtgaaaagagccaagtctggtatggaagacaaggatgtttaatgacgcatataatttaatacaaaataaaaatataagaaaagcgaaaaagggaagaaaaatcaactcagacaaagactataattaaccaaatacatatggggccaaaacactaccaccctttgtctcaggagccacaacgtgaatgaagttaaataaaactgtttaaaagttgattctgagtatctcagagaaattttcaagtgcttggcctcagattgccagtttccctgttaagctgaggacagaaaatggagaaaggcctactcaagagaagtcagtggtcaggccacaagaataatgagccagacgaggtagtcgacattctagaagtgtacacattcactgggctctttaaggatggacaggggaatcctctcccatttgggtcttttatttctgaagacagaaaatagggacaagattgatcctaaacaaaaacgtaaggtaaactctatttttaaaaacctttccctttgcattcatttacctttttcccacctcctgtgtgcatctaattctttgccaatatatcaagaactctgtgcctaaaaacaacacagtgtggtggaaacaaaatgaaatatggaaatgtaagtttagaaatccgcagtttcaatctttctcttttgcttatggcatgtggaggaggtcttggttaagtagtctattctatatgagtttctgttcttataaccctgaggagctattataaacaatatgtcatatacatgtatataaacatactttgtgaactgtaagtcactaaataaacttcatataactgctatgtaattacttgtctgctctatagtggctcatttgatgcgatattatgccattaacctgaaactccaaaattcacctctctccccgctccctttatccaaaccatcatcttttgagtatcacaagtcacagataccatattttaaaagttaatcagactaaaggaatgcagagtaagattttaatctcctctaggtatcctaaagcattatatgatttacaaacagaaggctgacctgatgttttataatatctcaggtagttacatgaactgcagtatttttggtgggggaggcgggggtggaggcaggggggtcggtccttgaacatacttccgtaacaactattaggctgttattatacacaactcgttgattttaatttcaggggattccgagaaatccgggatacctagtcagagagttagaggtagaaagcttttaaaggctcatatttctagccccaacatgtgcaactaatatcagaagagaagcttattctaattacttttttagtaatttagattatactcttgaaacccactgtgttgaaaagaaaataaataacccagcactgtgtctcaatatgagatctggaagtcacaataattgatcacactgaaatgctcatcagttagtatctacctttatgtcaacccctatatggcatcccctttgctacttttcactgcaatcaattgtgtctacttgaaagccaaagtatagaaagtctggaaggtaaaaattgctcaaaaagagttattaaaaaaattatatgtgttttataaaatcattgagaaagaagagggtatcaaaagaagagagtagaggagagcatctgagtaagattcttattcaagtgttagaagatatgggaaaagagtcagggaggagtcagacattagaagcacaagggagccaggaaagagaacaaaaagtagatataattaatagggtgaaatgctgaccagaggtcaagaccacacaaaatgagaaatgaaaggacctaagctgaatctggaattatgaggttgtctatatcacaaagagaataactctacgacagtgatgggaacaaaagcatatacataaaacatgctaaagaatcgtagaatagtgagagagaaaattcttaatgtaaagtggaatatagttcttaaggaaagtgggtgctggccgggcacggtggctcacgcctgtaatcccagcactttgggaggccgaggggggcggatcacaaggtcaggagttcgagaccagcctggctaacatggtaaaaccccgtctctactaaaaatccaaaaattagctaggcatggtggcgtgcacctgtaattgcagctactcgtgaggctgaggcaagagaatcgtttgaacccagggggcggaggttacagtgagccaagatcacgccattgcactccagcctgggcaacagggtaagactccatctcaaaaaaaacaaaaaaagaataagaaaaaaaaagaaagtgggtgctgaactggatcacaatagatgagaagaaaaaagtgtaaaataaaaataagagaatgaaggctgggcgtggtggctcacgcctgtaattccagcactttgggaaaccgaggcaggtagatcacttgaagtcaggagttcgagaccagcctggccaacatgttgaaactccatctctactaaaaatagaaaaaaattagccaggcatggtggcacatgcctgtaatcctagttactcgggaggctgaggcaggagaatcatttgaacctggggaggcagaggctgcagtgagctgagattgcaccactgaactccagcctgggtgacagagtgagactctgcctcaaaaaaaaaaaaaaaaaaaaaagaaaaagaaaaaagaaaaaaaaagagaatgataacagcagctaacataattgggcatttgctatccactatacactacacacatgcatgctctcctaatctcaccacagctctgtgagacaggttctatattcacgtatattttaacaaacaaaggaaatgaaattgaaagatagtaagaaactcatacaacgtttcataactagatgtggtaaattcagaattcaaacccaggtcttcacaatcagattagaaacacaaggaaggacagttgaaggtttctggaatactaagacaaagttttttttaacccagattcaagtctcagtactaagaacatattgccaggcaagcctcaataagccaagagctaaatgattttagtttttcatatttaaaataaataaagcatctgagagaaatttacttattcattcatcaatatttattgtataataccatatattgtttgaggcattaggaattcacaagtgagtacctgacagaatgattcctgccaccatagatacttatggcaggctaactaggttagtggacagagcgtaatacagtaaatgagaagccgatgagtactagggagaaaaataatgcagtgaagaggtgtaatggttaatattgagtgtcaacttgtttggattgaaggatgcaaagtattgttcctgggtatgtcttgagggtgttgccaaaggagaagattaacatttgagtaggtggactaggagaggcagacccaccttcaatctgggtgggcacaatctgatcagctgctagcatggctaggataaaagtaggcagaggaacatggaaggactagactgacttaagtctcctggcctccatctttctcccatgctggatgcttcctgccctcgaacatcagactccaagttcttcagcttttggactcttggactgcaccagaggtttgccaggggctctcaggcttcggtcacagactaaaggctgcagtgccagcttccctactttcgaggctttgggactcctactggcttccttgctcttcagcttgcagatagcctattgtgggacctcaccttgtgatcctgtgagtcaaaactgcttaataaactccctttcatatatacatctatcctatcactcctgtgcctctagagaaccctgactaatacaagaggaaaagaagtattttgagcaactgattatgcaatttcaaagaaggtgcattgagaagacttccacaaaggacctgtgaaaaaagaccagaaagaaatgagagaacaagccatttgaataactggacaaggcaaggtacaagtgagaaattctcaagaatgtgactggcatgtttaggaaacagtatagaagccatatgattaaagttgccttagccagggggaatggtagaagatgaggtaagaaataccaaggcagggacaaattatgtagagccttgtagactactacaagaattctggactttcctctgaggtgggaagtcattgtagggttataggtaaaacagaacattatgtgactgaagtcgttggctgttgtgttaagaatagactgtgttaaatataacttgagatgctatatcaaattctttcacaaattttacatgcacgtgatataaaacacaagcaaaattttgtaccttttgccatcaattaaaaagaagagagatcaatataagtcacagttgaaatttcaaactttttgagaaactcacaagttattagcagctcaaggaaatagcatattattctgatcatgctgggtttttattagttctaataaattaaagaattgcagagttatttaatatagctgacattctactaatttcaagggaaaaagagtaacaaaagctcataagagaattcattcagagctcaattccacttatcctcccactctacagagaacacaattggcagcatgtgagtgattttttccctgtaatggcaggatttgatattactattttgatggagatttgaactaaataagctcaatcccttgattaaatgagagttattttataaaggaatatgcctgcacacttctggcattttaactttatcttagttcataatacaggaactatatatttattatcatgatgtattagagattattccattttcttccatatgagagcaaggtctggaggcaaaaagttttttttctttcactgcacagacacacgttgtcatggccactagcttctttctaaatgtccctgatgaattatataccctacaaatgccaaatatccctctcaccccaactcatggttagtttttgaaacaaactgcaatagtgttatatataaaatcaccttgtacaattccctaggtaagggattgcaattgtcctttgagaggtgataaccagcagcaaaaacaaacaaaaccttgctgatgatgtgcccctctccagggagaagactgagaaaaacagtaaggtttgcatatttcaccttgcccttcactgcctcttgtgttacatttctaattcactccctcagtgatttcatccactcctatagctttgtatgtgacctgtatgctattggcttccaaatttataactccatccctgaactcccagcttatacccccaaatgcatgcttcatatgtccactaagaggtcaacagacccttagttatcttcccttccataatctgcttctcttgcagactttccctcatctctataaatgggaactcttatctaattttacagcctaagaacctggagttattcatgattcctcctatgccccaaatccaatctgtcagaaactctaattcactattttcaaaatcatccagaatctacttctcaccaatgacactgctgctaagcctgtcaaactaccactaattcacacattaataatgagatcattgaaatagcttgttaaccagtcactggctttaattatattcctcacctcaccctactatctgtttctccatatagctgccagcataacacttctatggcatcagtctgatcatttcacccctttgttaataactcactaacggctttcttaaaataaaatccataattctcacactatggctgcaaggccatgcatgatcaaggccctggtggcctctttacaccgtctcccaccttcactctgccacagccactggcctcacatagccaaactcacttatccctcaaggccttgctgtttgtggtctcttctgtctataacatgcttccttgagatatccacacctctaactaaagtcactccggcttctgctcaactcttacctcttcagaaagtccttcctaaccacacaaattgcacacacaaacacactcatcctaccacttcctgcagagcattcactactatctgatattacattattatttatgcatatattgctaccatccccaataaaaatatatgacaaatagggactaagagaaggatcatcacatttaactcagagtctgcagcaatacctagcacacagtaggtgttcaataaatatttgtcaaaaaatgaataaattattgctgaatcaaggagacaaagtatttgaagaaaatttatcagacaatggtacagtctaccaatacaaactcaaagtctaagtttctccaacaaaatccaagtccctgaaacatccaaagactgaaacatacactactggaatagttgctaccaggaggcattccccaggctgaagtgcagtggcacgatcttggctcactgcaccctctgcctccccagttcatgcgattctcatgcctcagccacccgaatcatctaatgagagtgcaaataaaaatgtacaaagttcttaagtatacccaacctatcagcagtaaaagcaatgttaagtttcaccattaaaaagcctctaattttccatgaatgtcactatatttggttaaatcaatgaatcagttacacattattttgactgttaaacatgtaaagaaaaactgtgtatggttgatatggtttggatttgagcccccatccaaatctcaagtcaaattgcaatccccagtgttagaggtgaggcctggtgggagatgactggatcatgggggtggatttccccctttggtgctgttcttgtgataagagttctcaggagatctggctgtttaaaagtgtgttgcacccccctcccaccttactccttctctggccatgtaagacgtgcctgtttcccctacaccttccaccatgatcataagtctcctgaggctttcccagaggctgatgttgccatgcttcctgtaaggctcgcagaactgtcagccaattaaacttgttttcttcataaattacccagtgtcaggtgtttctttatagtcctagcactttgggaggccaaggcaggcagatcccttgaggtcaggagttcaagacaagcctggccaacatggtgaaaccccatctctactaaaaattcaataaatttagccaagcatggtggcgcacacctgtaatcctagctactcgggtggctgaggcatgagaatcgcatgaactggggaggcacatggtgcagtgagccaagattgtgccactgtacttcagcctgggcaatgaagtgaaactgtctccaaaaaataaaagtaaaaataaagtgacaagaaaaacaatgactgaatgcttatcttaaaagatgcatacctctaagatttaaaatagctagaaatatagttatgaaataatagtttattatttcaaaccaatgttctcactgtgtaatgaaagatttccagacaagattaccaaatggccatctaaagcaccatagaacttgagggaccttggacaactggacaaagcagtagcagtggatgaatggaacttctcttttccaggaagagaagacagtagattctgccaacttcagactgacacaacttatgtaattgacagacgagatcaaagatgaattattaaacagaaaaggaagtagtaattacaagaaaccaaaatgggttcttgaaaaaaattatatcagagtaactgtatgtctttgttaggagactgaactctgggaaacatgattgattttgtatctggacatttgcaaagctttgaaatattcaacacctaaggaatgcaagaaagacttggagatatttagtctgggaaagtgttggtttggtggagatatcctttcagtttcctcacctatcttggtcaatgttttttataagtgtttcagtaagccatgattcttataccaaatcacaatttcctcaacatcttttatgaaataaaaccactaagtactaaaacaagtattgtatagagtaccatgagtagtcacactcaaaacaacatggccttctgagttaaaaatcaggaaaacgttcaatctaagatgttgtactagacaaacctagaagttaaatggcaagatcacttagggtttaagttctattctttaaaaaaaaaaaaaaagtgtgaattatgcaccaagttattgatttcttggtctacttttgaattaacccattttcactcatagagaaatcatctacagattcatttttaacaaaaaaatcaaaaatactcaaaatgatttttaaaaacactgttttcattttattgttcttgctatactttttccatcctttctgttcatctattctttatttcatacattcacttaacatacatgtatatgttatgtggcactatgtgtcagtagatgtgccatgtgctgggaatagaaagatgagcacaatacactctagcctgtcaaaaagttcagagcataaatgaagactgtgacttgtaaaataacacttatattccagtataatacaagccatttagagatatgcacagagttctctggtaacaaagaggaaagatactgaattttgtatagaatgaagtgttagggaaagctccccaaagaggcttcctcaaaggggaaagaagggaaaggcagaatattgacaggcttgagcatgatgctttcagagctcaacaaattgtctagcaatgatgaggcagagagaaaaaaagtaagataggaggtagaaggggaatgttaggaactgcttcatttaaagacgtaatgctgggtgggaaggacgggattacagatgagcctgaggaaacatttaggggtaatgggtatcttcattatcttcattgttgtaatcatttcatggatgttttcatatgtcaaaattaatcaactgctgtactttaaatatatgccatttattgtgtcagtttaccgaaatgatactttttttaaaaagttttaatgctattctaagaattttgggtaaccgtgtgaaaggctcggggagcaactgaaggaatttagagtcagtgaaacatatttaggggcatttcattctccattttacatctttacaagatcctctatttaatcaaattaaagaattaaccaactgctattttccatgcacctgtcatgtacaaaggaccaatgcgtccctaaaaaaaaatcacatctctatcgttaagtgagttatgcagatcttcattttaattcacttttaaaaccaaacttcaaagatgcaagatacagcagacgtcataaataaaaataaaaagacaagtaagaggcagtgagaaaaattgcaaatatttacaagagtagcgctatagaacatataaggagctcttacaagctacaaggcaataaaataggaaaataaacaatattaataggcaattctaagaaaaaatataaacaaccaataaatacataataactgcttcgatctcatttaataaccaagaaatatgaaataagtaaaataaaagtcaccaactaaaaaagaaaaacaatattaatgattatgcaaggaaaagaatcctcacttatattattcataaaagtgtaagtttggccaggcacggtggctcatgcctgtaatcccagcagtttgggaggccgagacgggcagatcacgaggtcaggagatcgagatcatcctggctaaaatggtgaaaccccgtctctactaaaaacacaaaaaaattagccgggcgtggtggcgggcgcctatagtcccagctactcgggaggctgaggcaggagaatggcgtgaacccgggagccggagcttgcagtgagttgagatcgcgccactgcactccagcctgggcgacagagcgagactctgtctcaaaaaaaaaaaaaaaaaaaaaaaaaaaagtgtaagttcacatgccttctggaaggacaatttgacagtaactagcaagattaaaaaggcctttcaatttagcaattcaaagactaagtatgattgtgagatgatttacatctcttcactctcaatttatttaatcctcagaacaatacaatgtaggtaggcactattactgtccctgttataggcaaaataacggtccctcaaagatatccatgtcctaatacccaaaacttttgaatgtgttgctttacatagcaaaagagactttgcagatgtcattaaggatcttgagatggggaagattatcttggattatctgggaaggcccaatataatcacagggtccttataagagggaagcaggagggtcagagaaggggttgtgatgccaaaaatagaagtcagagcaatgctgaaccatgagccaagaaatgctagcagcttctcaaagctggaaaaggcaaggaaataaatttttcccctagagccctcagaaggaatgcacccaagctaaaccattttggactattgatctccagaattgtaagatcataaacttgtgttgttttaagccaccaagtttgtggtaatttgttatagcagcaacaggaaactaatatagtcctacttcataaataagaaaatggaggtatcaaaaaatgagtaacttccaaagatcatatagctaggaagaggtacagctagaatttaaacccagacaatgtgcaatactaatgcactgccttcaaatacaaagatgtatacagaattattttttaaaaaacctgaggcacggagagaaactacaactaagtgtccttcattaagagaatgattaaaaggaaaaatcataatatgggctatgaaataaaatgcacgaatttaaaaacagtacaacatgaaaaacatattcaaaatatatgacacagccaaaaagtttcagaacaatggattttttaaaatgttcacgtgaacatgcatacattggtaaatacacagaaatggaattagaagtacaacagattgttaaaaatgatcatttgtgtggaatgaaaagaggtagtgggatacgggggacatctacattgtattcaatatttctatgttatttgaatgttttacaacaagaatatatgatgtattttaaagcgagggatttttaatgcagggagatatgcacgaatttcctacaacatttttcattaaaaaggcctcagctgcacaaagtttaaaagccctgccctacagtgacaccaaatggtggtagatcaaaatacagcacacaaacaggacatttgttcgattcaatcttcctataaatgtttgatttctttgaagaacaggaagcttaacagaattaaataacgtggagacaaatactcaaaaacctagaatttttaatcaaagaaagtctagtacaccaagcttcaactgcaaatttttaggcctctttccaaacttcagctaatcttctgatcccactgaatatttacataaatcatttctcacagttaaagcatgccactgtgaacacagtgattttacctaatagcttattgatcaaagaaagcctacaaatacaagaaatgcagtcataaaactaaagtcaggctctactccatcggaatcaacccttggtaagtaggtaatattttggaaagatggacgagaaggtgttggggataaacagggatggaaagaatccaagaagagacacaagcaatgactccaattaatgacaaagtatattttcatttgttaatctagtgatagaaaattaagctgagtaaaagaggaggctattgcctctcaaatatacaccaatttctccacaagaaaattttgtcctggactgtccagggaaaagaatatttcaaattaagcacatcagtcagtattcagtgtcctctgcccagaacctaaaccaacaaaaacagcatgtaaatggccttattcattacaagccactataaaaagatacagagatagaccacctctcagggcactcctctaaaacaccatttggccaggatccttagtcttttagcattaaatgagagtttattggatttttgatgtgttacttttcatataccaaaatctcctagaaaacacaggacatataaatatatgatcatctacaaaaaaaagtcaataatataattaagctctaaggccttgaaatcatataactggatttcaatcctaataggtacaagccaacttacgaccacatgttaccagcactactttaccccactcatggataatcagctctagaacaccttgagagctatcctgatcaaatgagtgcatgtccagtgacaagaaccacaaggagatcagttcaagaaggtaacttaagtttctgaattactatataagtgacagatgaacaactaagaactgagtaccacaaaaagtatccatgtctactacatatacatttatgacttaattagaaagagaggtaatatcagcattaaataattttgcttccaatttcaacagagacataaatatgaacatgaaagtctatattacagaaaatgtgaaaaattaggcacatcacatggtttagtggttagaagtttcaaggatatacaatttaatagaaattgacataattcccacagtaaatttgtataccatactctacaggatatagagccctagaaaactgtatctaagtgatacatgataaaagtaagacatatggccgggtgcagtggctcacacctgtaatcccagcactttgggagatcgaggtgggcagatcacaaggtcaagagatcaagaccatcctggccaacatagtgaaaccccatgtctactaaaaatacaaaaagttggctgggcttggtgttgtgcaccaagctgtagttccagctactaaggtagctgaggcaggggaatcgcttgaacccaggaggcggttgcagtgagccgagatcgtgccactgtactccagcctggtgacagagctagactctgtctcaaaaaaaaaaaaaaaaaaaaaaaaagtaagacatttccagtatacaaactatttctgatatatgctaattgaccttaattgacattggttactaatattttagatgtcttacttttacaccctgcctttctatcaaagaggaaaataacataaacatcaatatcctggtggagctacatcttatgttttttaactaattcttatggagaattaaagttgattatataatgcaagcaacttgactgaatttaatctactgtctcaagttagggtatcagtttaaataaaacacaacctttcagaaaaaattgtaattaatatgaatcaaattaatgaattcacataactggataaaagaaaacttaaacttagtggcaagtaaaaactgtagaattttaactaatttttgttcaaatgaaaatgctagaaatcataacatcagtctacggaacctaaagatgaaagagttaagagctaatttttctacagtgaaaaacaaatgaaaagtcaagctttggtcctatttggagctgggaaagcactaacactaccccaaactcttgactttttcttatatctaactgtgtgatgatttttcaggtaaagatgattagcacatttctaatgtactttaaatctaggctaaatcaagaagtaaacatgtttttaaggcaaggatgtcttgtagaaatctggagtttaattcacttcaagttaattgcccatttttgatacaaacacttcaaaaagtttattactttaaaaatgaaacattattatggaagtcttacagaaatacacttggcaattataaccaatttcttaaaatcatcaaattactgtattattgataatgttgataaactgaaaacacatcattctttagtaagttagcaaaggtttttaatctagaaaggagtacagaaaatttcagacattccagactgtctaacactctttgtccagtattttgttttttttttttttggttaattatcaaggattgtttggagctttaagcaggtttcccacttctctttggagagcaaaagttgagaagtagtagcagccagattggaaatggtgaaaaatagaaatggaaaaaggtaaaatctaagaacattactatttgacaaaaaataaaataaaaatatttcattttgttcctcaactttcattctgatttttccaccaatacaattaccttttaaaatattagtaccacagaaaccagaaccgaaaacaatttgttcaagagtatattgtcataatcaatagatgactaaggcattgttcatattgtctgtagaggatgtttttcaacaacgttattccttccaaattatattccactggcactcaggtatgacccagcatggaatgtgtacattccagattaagtttgagttgacatgtcctgaaagggaagtggtccatcaccatcttaaaatcaaaactattacctctagcattggtatctgggaatccagttgttttaactgctgatccctaaaagtacactttttgtaaatcaaagctctttgatgtgaattcttaatttttaacaaggcataacttggctattttaagtaaattgaaaatatctgcaaatttgagcagtcttcttgaatcactagaacacagaaatagttttaaatctttactataatggtaggcaacataaaaagctacttgttagatagacattttcatataaccttgcatggtatcagatttaatgtacatggaaaatatttcaaaattgtaattttatatattattttaattcaagtgtcaaaacataggtaaaaaaaaaacactctaaatagtctgtggttaaaaatgtaatgcaaattctcccttattcacctattctcttatggaagacatggcaaatagagtatcaaatagacaaactaaccaaataatagaaaagcaagcaagcagggaaataaagaaaaaagaaaggagacagaaaaggggcaggcggggaagagaataccctgaagaattggagtaaaaagtaaaaactttttttgttttcttaaagacaacgaatttaaaagttttagaaaaggccgggtggggtggctcacacctgtaatcccagaactttgggaggcggaggcaggcggatcacctgaggtcaggagttcgagaccagcctggccaacatggtgaaaccccatctctattaaaaatacaaaaaaatagctgagtgtagtgttggccacctataatcccagctactcaggaggctgaggcaggggaatcgcttgaacctgggaggcgcaggttttggtgagtcgagattgcaccacttgcactccagcctgggcgacagagcaagattctgtctcaagtatttaaaaaaaaaaaaaaaaaagttttagaataagaattataagactgtgaacaaggaaaatcatgctttttccttttgtgttctatttggagtttttttttttttaactttggtggtagcaaggagtagaatgcgtttatgaagagataggaaggaatgtaaaagcaaatgtctacaacatgccaaaatatgaggtgcaggcacagctattaagtaaatcaacctgaatttttaaaattctgtcaaacaaatttcatcctggccctggagattattaatataactgaagatgaaagggaaaaaataaacaatcttattagagaaacaacactatagtattgttataatgacaaagtgtaaccgacctaaaaataataatttaatggtaggagaaaagagcacagaaaagaaatcttgataaaaatcttaaaattttaagttgtaatacatttaatatatggcattggaaattcttttcacctctttagaccccagcttctataaaataaaaggctggagcaagatgattatcaaagattttctaaaatgaattcatttttcatcctcattgccaagaaagatactatatttataatttcggtctaaactacgagatgaattcaagtaagtgatcagaacaagaaaccaaagctactcttgcaatatgttggaatacacagctctagaataaatcacaaatatacctctctattcttaagaagtacagtttttactttacattttaacattaaatagagagcaaaaaaattatacatacaattttcaaaagccccttggacttcacttaatgccagagtttcaatatatattttaaatcaaggtaatttcacatgaatatccttaagttaaaaaaaagtaagatggatattaaatgtatgtgattactcacatgcttttttacatttagcgatataaaaacagttgacaggttctcttgtttggcacagtataaaaatcctctctgagactcggtacttaccacaaccacaaactgctcaggttcacataagttgctatattcactcttgaactgagacaatgaatttaattgctcttgatcaggaagatgctttattaagttctaaaaattaaaaccagaaagaaagatcttcactaaatgtacttcttgaattttaaaaatataatttaaaaactactgaaagaaaaccagtgaagttaatcttcagttttatttctaggtaacctccctcctaataagccttaagcaaaattccctgcatcttgaaaacagtcaattttccatttctctatcccagagttattatatattcaaatcaagcactactgaaactgaatgtttatttgattagctatataattgagaaagagaactcaacctataccaaaggaacagctttctcacctggatgaatgtgatccattacatttcagctttagggaattaaatgtcagaaatttcaggcaaagccaaacatattttaacacttcactcagggggataaaagaaatcatcatattgctacaaaaaggcatgggaagggacagaatagaaatcaagggaattttaatggcagtgcttgcaagatttaccaataggattacagttttaataataaaaactgaagatatctctaaaacaaactaacttttctgatgtgaaagaaaattttaaaaggtgttgaagacacatgatgattgatataccttgcagataaaaggcatgtagaggtcctttagaaacttaagtaagccacacacttaaacaacagaactacttgaataaagattaaaggaatacacaagactatgtcttcctgatacaacttaaatgattaaacaatcccttggacaaagtctatatcgatcctctgtatcaaaatacaatcaactataatagcgttacaagaagttagtgcattgatattaaaattaagataaaaaagagtggttggtgctcacaattccaaattacagcatgagtaaattctgtacaagcccaaagttgaatacaaactataattaagcctagatcatgctatatatatttatggggggaaattccccaaaggtgttattagttaaaaatactgttagagaatgttatacatcaaaatcaattagatcaaagaataagttattgactcactgtgtacctttggacaaaaacttggttaactggccaaaaacaaaacaaaaaaaaagtggcattttaagatcatccctagacaaagtattcactattaatactatcaaattgaataaaaataaaagtatatgatttccccacataaatagaaatttctcttagtggaattgcttgagaccaaaagacatgattatttatatttttacccattctagttgacagctggattgttagattttattacttcaggcctctgaatttctttagcatccttttagacaaatccccctgaatatctcatatataatcagattttcatctttcacctgaattttttaattttttcactccattaattttacattctaacataaaaatactattgtgatttttaagtgcgtggttccaacctccctttgtctctccccttacaaattccccacacccttcgcaaatcttaagctactgttcagctaaattctgcacagacaggcacgcatgcccagcttccctcacagcccacagtattattactgccaaaacaattgcccttcactacatttttcatgcaactcctctgctctattctacatctatacctattcaacatttacatacccttgcctccacacatacactcacaaagcatactccctcaacatattctataggtctaaaccaatcttaaaactttgcttaccttgctttacaattatgtatgtaaatgtcatttcccttgtcaaattataaattccaagaaggtcaagtctaattcttattgagcctaatatacagccgggcatggtggctcacgcctttaatccagcactttgagagaccgaggtgggcaaatcacttgaggtcaagagttcaagaccagcctggccaacatggtgaaaccccatttctactaaaaatacaaaaattagctgggagtggtggcgggtgcctgaaatcccagctactcaggaggctgaggcagaagaatagcttgaacccaggaggcagaggttgcagtaagccgagatcgcaccattgcactccagcctggttgacagtctcactctgtctcaaaaaaaaaacaaaagtaataaaacataaaaattattgagcctaatacaatgccctggacatgttgcataaaataaagtatatgaaaaatgaattaataaatgactgatgtgacaaacaaaggtaaatgggtaaaaaatgatgcagaaaagtggcatgaaaaatggcaaaacaatgacatactgctgacctgtacatatatatgaataagtaactaaatatgtcaaaatataaccatcacagtgaacacagagaaccaaaatcatgattattacaacataaagctctgtttccatgccctggtcaaaataggaattcttcgcattaaaatgaggaatatacttttaaaattaagagttcaaatagcaagaaattcttactttttaatgaatatattaaaaccttatatatgttcaaaataaatttttacattttagaaatacccaaggctggttttatatttagaaagtatgataggcacaataatgacatccattcctaaagatgtacatgactaatccccaaaacctatgaaaatattaagttacatggcaaagggaatttaggttatagatggaattaaagttgctatcagctgaccttagagtggttatcctgaattatttggatgtactcaatgtaatcaaaaagttcttataagtggaagaaaaaaacaatagagttggacggagatgtgactatgagacaaaggaattgaggaatgcaagattgctggcttggaagatgaaggaatggttctacaagccatagagtatgagcaaccatgagaagctggaaatacaaacagattcttccctagagcctacgaaaagaaacacaggtcattctgccaatactttgatgttagcatagtaagaccaatatcagacttatgttttacaggaatgtaagataataaatttgtattattttaagcaaataagttcttggtgaatgggtatagtacaaataaaaaactaatacattacaaaatatatggagctgaatgtactttggacatgaattttaaaaagcaaatcatctcttttctattatataacaaaaccacatgttcatttaaaacattcatgtaatcaagctaaaagctactctgtaaatatttaactaattcattataagaaatacaaacaagtattaagtagaaaaattttatttaaggaagttggcatctattcctagcaagaaggcacacatataatcaacatgaacgaagatgaaaatccagtaaaaaacaaactgaaagagaaaaaaaatgcttaaataagagtagctgaatcaggtagtttatgagtctcagcgactcacagcacaaatcactagtgaaattatatgaccactacatttagaagacaagataggaaaggcaaaacttagaacaacttccaaagatatcatttattgattagttaaaatattcagaataattttaattgcttgttggcactaataaatatttggtttctttttattgctaagtaatcattttcctaaatatatccgctatcagaacaaaagatggtaagctgaagataatctctcactatataatttgtgttttgattctccaactttaaattttatcaagatatacattattgatttcttatgtggaactcagcaataacttcgacatgatgctagtattcatttgaaaatactatgaataaaagccattaacaaaaatcttctagctttctgaataaattcagaatactatgtaaacaatctctaatactcataggagcccaaatgactctaagaagaattgttagtaaaggtaactgtaattgaaaactccctcaatcttctaaaccatataataatatcttcataagccaaagaaaaacacattctaaaagggctatagaaacaaattttaagtaacacattaataaagtataacaaaaacaaaaatgtaaaattaaacaatttgcttttcagaaacaataacttaaaatacttaaaatgtaatcatttgatagcattctatttcatgtgcagttaagagaagatgcagctttctctcctggcaatgcagaagttatgctaaaactaattatgcagcaatgattttccagttgaatgatttgggtgaagaattttgcttcacttacagatttctatttaatgagaagcttgcaatgaaatattgaaatttaagctgtgcctgtttgtttacctgaatcatagactctgccaaccgtgtttcatctacttccaatatcatcattctgatttcctcatatggcacccgaaaagagctcaggaagattgctaagaaggagaaagagagaaaggtttataatgaataaggtttaaaaaagtatttcagatgtagttctatttataaaatcaaaaataaattcataaaacaagagaattcaaacatttaatattatgtttgggggaaacatattatgggggaaactttcattactacattttatactcttctctagttttagaactagtgtttaaacaacagtcctgtgttattgcactggatccaaggttgatttttaaatgctcagttatttatctaccataggaatgatgtcaattttcatgtgataacaaaaaatgaaataaggtacactataaaaacatcacattgtaatgaaaataataagaaaaccacagtatgtgcatgtaatatttgtctaagcatatgtattatttgcttgtatctcttctagccttaggaaagagttcaggaaaaagtattttaagaaaactgctaagcagtacattaacacttttacaagtaatagtagcacttcactattcagaaacattgtaaacagtatgctagggaaaccttcacatgtaaccaaagcttaaaatatccagttttagaaaacaaattctcactgaaaattatccaaatgtactagatagtataatatgttattactgagaattctaaacatctttcttgatggctcttatatcaactattataatgattttttcaaaagttactgaagtagaaggatattttcacagcaacagatacaacgcttttgctagttcaacccttattgtactattatgtttttacattcaagatgtcacttcttaaccatactcagcacctgcaaatcaatagcctattatttttctttttatttaatgaatttctatgtcatctggtatgtgtatttctagataaagaaactatgttcagcacctcatatctgtgggttccatattcacaaatctgaccaactgtggatcaaattcaatccacagtaggttgaatctaaagatacagaaaccatggatataaaagcagaatataaggaacttgagcatctgtggattttggtattcatcaggggtcctggaaccaatccctctgatatcaaaggatgactattttttataaaactcaggaaacaggatctacttcttttctgtattgaggttgtattcctgatttgtgagaatatcatgtatcacctacagattaacaagggcatcatctgtattcatatcaccaacacacacagttctgaacccaagaagtcttaaatatgaaatcattacaataaaactcacagatgtctataatccttaatatcccaagaacaagatgaaatatgtaaatggtataagagtaaatagagatttggccaggcacggtggctcacgcctgtaatcccagcactttgggaggcagaggcaggcggatcacgaggtcagcagatcgagatcatcttaactaacatggggaaactccacctctactaaaaatacaaaaaattagccaggtatggtggcatgtgcctgtagtcccagctactcgggaggctgaagcagaagtattgcttgaaactaagaggcagaggttgcagtgagccaagattgcaccactgcactccagcctgggcgacagagtaagactctgtctcaaaaaaaaaaaaaaaaaaaaaaaaaaaagtaagtagaaatttataaaattacaaaagacaactccgtagtagacaatagaacatgcaaaaaatataatcactgaagatggtgaagtagggctctccagtaattctccaccctcacagaaacatgaatttgaactagccacatgtgaaagaaaataccttcaaaagagagaaaacaagtgaaaaatcacagtacctggtatagactaatactaaaaaagatacattgattatgtaaagaatgttttacatcacccgtatcaatccatccaccaacgtcaggcagcacaggaaaaaaaaaaaaaaaagagagagagagagagatactgtccacttgaaaaaaaagagaagtgaacatagaaatttccctttgtcgctaacaacaaatctaccagtataaaatgctcatggactctgattcctgacaggtatctgcagtctaagcatctagactgacactggtaccagacaggaatctaacggtcctttgagaaaagactcgagttctggcctatatcactgacggatgactgcagcgaccttcgtttacagaaaatactcagtggcaaacaggcaacagaagccatgggcttcaggaaccacccaggactgcaacaacattaagaaccacgaaagtaagcctgatgcagggccagctgtgggagccaaaaatttccagcctgggctgcaccacccaaagcacttctaggcttagggcactccctaacactgcaccaacaacagcaacccataccagatggtctactcaaaaaccctagacagacttactgttgaaagatgacctaaaataaagtcacactgagaagaatggaataaatatctacttcttcaacatgcagacagcaacacttgaccacaatgcaaaaagacaatcagggaaacatgacatcaccaaagggacaaaatcagctgccagtgatgtacactagagatggacatgtatgaactatctggcaaggaattcaaagctgtggtttaagaaagttcagtgaacttcaagaaaatacaaaaaaaaaaaaaaaaaatcagtattttttaacaaagaaaacagtttttaaaaattaaacagaaatactaaaatatacaaggtacaaaatgagaaattcagtagagagcatcaactgtacaagtgatcaagcagaagaaaaaaatctgtaaacttaaagacagtttatttaaaaatatactgtaagagaataagaaaaatgaatgaaaaggaatgaagaaaacgtgaaatttattggacagcattaaagagcaaaaacgtgtcattgaggtttgagagagtagataacattgtagaaaacttattttaaaaagtaatagcagaaaactttccaaacctgcaaaaagatataaatatccagatacgggaaggtaaaaggtgtctagtatgattgaatccaatactacaccatgacattataatcaaactgtcaaagatcaaagacaaagaggggatccagaaagcaacaagagaaaataataaaatagcatacaagagagttccagtatacctaacagcagacttctcaacagaaaccttacatgccaggagaaaatatgatgacatattcaaagtgctgaagaaaaacaacttctaagaatactttaccgtcaaaatttatttttcagaaatcaaggagagatagagtttcccagacaaacagaagctaaggaagttcacaatcaacagccctgtcttataaaaattgctaaatgaaattctgccagttgaaagaaaaggatgataatgagaaacataaaaatatctgaaagtataactcaccagtaaaagtaagtacatagtcaaattccgaatattctaataatgtaatagtggtatgtaaatcacttgtatctttaaaagggagaatagaggacaaaactattaaaattaatagtaactacaataaattgttaaggaatattcaatatggaaagatgtgagttgtgacatcaaaaattcaaaattcaaggaaagagtaaaattaatatgtagttttattttttataagtgatcaagtttatcagtttcaaataaattgttgtaactgtaaaaaatcttttagttagcctcataaccacaaagcaaaaatctatactaaatgtactacaaattaaaagcaaaaaaatcaaaacatactattagagaataatcacttatccagaaaggaaaactgtaatagaggaagaaagtaaaaaggatctacaaaacaactagaaaacaatcaacaaaacggtagttataagtccttcactatcaataattatctagcatctaaatggactgaattctcaaattaaaagacagagtggctgaatgaaaacaaaacaaaactacaactatatgctgactattgaagactaacttcacccgtaaagacacatataaaccaagtgtaaagatagaaaaagatatgccatgcacatgaaaaccgaaaaagaacaggagtagctatatttacatcagataaaatatactttaaaccaaaaactgtaaaaggagacaaaggatattacataataaagtgatcaattcagcaaaaggatgtaacacttgtaaacatatatatgtgtatatgcatgtgtgtgcgtgtatatacatatatatgtatatatatatataatttgtatccaacaccaaagcatctaaatatacaaagaaaatagatctacagggagacatacattgcaatacaatattaggagacttcaatgcctcattttcagcaataaaacagtcatctagacagaaaatcaacaaacatgaactagaaaatgaactctaggccaaaaggacctaacagatatttacagaacatttcatataacaaaatcagaataaacatccttctctcaactgcacatggaacattctccaggacagatcatatgttatgccacaaaacatgtcttaacaaatttaaggagactagaatcatatcaagtatattttctgaccacaatggaataaaactagaaatcagtacagaagaaaattcaaaaacttttcaaatgcatgaaaactaaacaacatgcttctaaataaccaatgggtcaatgaagaaattaaaagtcttcaatataaaaatgtatttagaaaattgaaaagggaaacacaacataccaaaatatatgggatatagcaaaagcagatctaagtgagaagtttacagaaataaatgtctacactaaaaaaaaaaaaatctcaaacaacctaacattgcacctggaggaattagaaaaacaagacaaactcaacccaaaattagtagaagcaagaaaatattaaagatccaagcagaaataaatgaaatggagaccagaaaataccaaaaaaaaaaaagaaagaaaaaacaaccaaaaatttcatttttggaaaaaataaaataatcaaatgtttatttagactaagaaaactcaaataaatatagtcataaatgaaaagatattacaactgacaccacaaaaataaaaaaagaattatatgagactattttgaataatttcttatacatcaataaattggataacctagaaaaaaaatggataaaatcctagaaacttataacttaccaagattgaattataaaacaatacaatacctgaataaaccaataaccagtaaggaaactgaaattagtaataagtagtttcccaccaaagaaaagctgaggatctaatacatttgctgcttaattctatcaaacatgtaagtaaaaactattaccaattcttatcacactattcaaaaaaaatcaaagagtagagaatactgccaaactcactccacaaggctggcattcccctgaaaccaaaacctgcaagaatgcaacaaaggaaagctacttgtcaataaccctgaagcaaaaattctcaacaaaatgaattcaatacatgaaaaagatcattcaccatgattaaatgggattcattccagagatgcaaggatggttcaaaacatgcaaatcagtaaatgtgacacaccctattaacagcatggaagacaaaaccatataatcatttcaatagatagaaaaataatttgacagaattcatcattcttttatgataaagaattttaacaaattaggtatagaagaaatgtgtcacaacacaataaatatatgcgttatatatgacaaacatacagctatcatcataacaaacagaaaagttgaaagcttttcctataaaatctggaagaagataaggatctccactttcaccacttctattcaacatattacttgaagtcctagccagggcaattaggtaagagaaaaaaaataggcagaaataagttaagctgtacttgcttgcagaaaacaaccttaaatataaaaaatcataaacaaatgaaacttataaaactcctaagccttctcttgatcctagtgtctggaaacctttatgaactcaaaaatataggaaaccaaaaccacttttaaatagacaagtagataaatgaatgacttttagattctttctccaaagttctaatctagtacatacccataatattctcttcaatgaactttagaaatgaacctttccattttagtatcagtattctactactgaccactgttttatttcaatttatctcattccaaaacagttctaagactcatctcagaattcagactctcaaaactctaaatttcatgacaaaaaactataattacaatgaagatcataggctgctaaagcttcttaaagcttaaatcataatgcctgctaccatcagagaggagaagaataatcttaaaatggattacatcataatatgacatggtataaattctgtatcttttcatcttacactttaaaacatgtttctcaattaaatgaataggatatatatactctagctaaattaaacaaggcaaacaggatctttctccataaaaatgttattctgttttctgtaaaaaggaacagatatacattaaactatataaacattaaaatattttcaaaatgagcaatcttattgaaatcacttaactgctacacccaccagattccctacctatactgttaatgctaatacccacctggtggggttgtagtgaagattaaagggccaaatacagaactagtaaacaaaggtaatcagtatttattagctgttttaattaaatttgaaatcccatgtagaacatgttctgtaatacataaataaataaccgtgttcaaaaagttatttaactatgagatggacatttaggctaacttaccacagctgacccattcagaaagaattctattaaacattatatttcttcgggaactattacaagactatttagaatcaacactagtaatttgtaatgcaggtcatgaacatttttcaaaataaaatcatctcttttagatcacagatacggaactttctgacattatctgacatagttcaaaacacagtgctttgaacctagacaaagttcttttgggagggaaattccctaaaatatgtacatcatgcaaaaaacaaaaaacacaaaatctctgtggtctaagcaaacacacacaaattatttctcatgaagaccatatgttcatcacaccagtttctgttaattattaattatgatccctatatcaggatgatggacaccactctgaatgccattctgggtgccagggggagcttcttcaaccaccaatgaaatgcttccaccccaaaaagtgacattaactccactcccatcttcactggtccaagcatgtcacttggtgactcctaacttgacaggggcagagatgtgcaatcagcagtgcccagaaatagagaattgaatactagacaatacaccaatgccgccatactatccatggggatcttggcaggcctgcattgtagaaaagagatgggtttagatcaaagtgattacgaaggagaggaggttctgaaattttcataaaaggaatgccaactctaccatttgaatatattgcctctaacataactctctctttaatcagtagcatggatctttatcctctcgctgaagaactgttttattccaatacttgctaaaagctcagttgaggcatgtaataattgagggagactaaaaaccatgttaattcttcatcactctagattctccccattattcatatccctcttgcaccatcagaaagtgatatatacagaccatagtatatcatctctaagcataactacctttgatgcatttagagtagttagaaatgagttaagagcaaaactatttgccttcttctctcacagtaatttggtcaagaagataatttaatactgagtatttagctcctgtaacagtaattaaatctaaaatatttctactcagaacttttgaggaaaggctttgaactgctcagatgggataactgaattcactttactcaccatccttatttccgttaatattataacctcctttatgtgtgatcaagtatcacaaatattagagattcagagttataaaagaagcaatacactaccaatttttttcaaaatatgatgtcattacctaaattccttaagtctttatttttatactttaaaaaaagggactttaaagagtagctgtttttttttttcagttatgaaaggtagaatttcattttaaaacctcttcttatttgtattttctaatatgcacttatcttttgaagcatttaatcccataatttacctaaaggagagttatctgtgaatttatcatgcatataataacaaaatgaaaatagcaaataatgaataatcggtcttaaagaaaatgaaatcatttaaagaaatatttccactgtctttgaatggtattggaatatgatacttacaaaggttctgggcaattttagaatctaaaaacttaagttctttaatttttttcttaatcgatttcttctcttcaatatcttcctcttctcttctctctgtaaaaccaagatagatccatgttaggggcagcaattcattcaaatacaaaagtggaaaaagtgaactttttatcattaaataagctaaaaaggatgtaactcttctaaataaaagttataaaaacaaataaaacgatagatatcccaagacctgaactgttgaagatagaaactgggagcttttatgccagagaaactatggaaagtaaatatttgaaggtctaacaggaaaaacaaaaataaaacttatgtatactatggaaaccaataccaatgggtataagaataactacaattagctcatttgaatagcatacaggatacagttataaaaattaaaacacctgcactcaagttgcaagtatattaattggattatgaagctagctctaagaatgctaactaaaacagtcattttatgtctaatatacaataccattcttatttaaaaacataccttatgaaaaattaacagaataaattttattgatcgtgaatgttgaatcatctatgcatccttgaaataaatcccatttgatcatactgtattatcttcgtgatgtactattggatttgttttgctactattttgttgaggatttctgcatctaaattcatcaggaatattggtctaagttttctttttatgttgggtcctcgtcttgtcttggtattagtgtaaagctggccttgtagcatgagttaggaagaattctctcctcttcatatttttggaatagtttgaaaggaattggtgttagttcttccttaaaaccttggtagaattcaacagtgaagccatccagtcttgttggaagactgatcaacttccttactcattattggtctgctcaggtttcctattctttctgatttaatcttggtagctacgtgtccagaaatttcttcatttcttctaggttttccaatgtgttggcaaacatttgttcataattagactctaacaatcctttttatttctgtggtatcagttgtaatatctccttttttgattttgattttattcatttgggttttctctttttcttctaatggtttatcaatttaatttaaaaataaaacaacttttcatttgtttaatctcatattgtttgttttttgtttgttttgagacagggtctcactctgtcacccaggctggagtgcagcagcataatcacagctcactgcaaccttgacttctcaggctcaattgatcctcccacctcagcctcccgtgtaactgggactacagatgtgtgccaccacattcagctaatttctttttatttttcatagagacagagccccactatattgcccaggctcgtcttgaactcctgccctcaagtgatcctcccacctcagcctcccaaagtgctaagattacaggtgtgagccacctcacccagcaatgtgtcttctttttttatctgtttcatttagttctgctctgaactttattatttctttccttctactaactttgggtttggtttgttgttttcctagttccttgaaatacatcactaagttcttgatttgaaatctattttttatgtaggcattttttgctacaaacttccctcctagtactgtttgtgctatattctaaaggttttggtatattttgtttctactttaactcatttcagaaatattttttattttcttaatttcttcataacatattggacattgagactaattgtctaactggacattagagaagcaagctgtataatttccatattatttgtaaagttcccaaagttcctgttgttgatttctagtgttactccattgtgagctacaaagatacttaatataattttgattttttacaagttgttgagacttgttttctggcctaacatatggtctattctggagagtgttccatgagctgaagagaagatgtgtgttgtgcacctactggatgctatgttctgtaaatgtctattagattcatttggtctacagtgcagtttcagattgatagttctttgacaattttctccctagatggtctgacaaatgctgaaagttaaattctccaactacaactatattggagtgtctctctccttgtagatataataatatctgctttaaaaatctgggtgttctggcgctgggcattcacacatttaaaactgttatattctcatgctgaattggtccctttatcattatataatgatcttgtctctttttatctctttttgacaaagtctgttttgactgatacaagtatagcttatccctgcacactttgacttttcatttacatacattacattttttcaatccctttgctttcagtcactgtttatctttacaggtgaagtgagttattgtagacagcatatatttgcatcccatttttttaatccattcagccagtacataactttcaattagagaatttacactacttataatcaaggtcattaatgggttagcacttacttctgtcattttgttgatcattttctaattgttttgtatatcctttgtttctctcttcctctctgtttatctttgtagtttggtggttttctgtaataacaatatttgcatcctttctcatttgtgtgtctgctctatagggagctttttacttttatgtgttttaacagtggtagatacagctttcttttgcttccagatatatgactcccttaagcagggagtctagcagtgatgaattccctcagtgtttgattggctgggaaagactatttctccctcacctgtgaagaacagctatactgagtaaagcattcttacctgacagttattttctttaagcattttgtaggtatcatccaattctctcctagtctgtaaattttctgctaaaaaaaattgatgttggtctgatgggcattctcttatatgtgacttgacacttttctcttgctatttttataaatcactctttgcctttgccttttgaaaatatgaatataatatgtctcacagaagagtttttgagttgaatctatttgggaatctttgagcttcgtgtatctggatgtctatttctttcccaagacttagagagttttcagctattatttcattaaataggttgtctatgccttttcccatctcttctccttccagtaatcccaaaacacaaatatatatttgcttaattttatcccacatgtcacgcagactttttaaatctttttctctatttttctttttttggtttgtctgggttatttcaagaaacctatcttcaaactcagaaattatttcttgtccttgtctagtctactgatgaaggtcttgattatattttttatttcctttattgaattatttgattcaagaatttctatttggctctttttttatatctatctctttgttgaatttctcattctaatcaattgttttcctgatttctttatattgtctacttgtgttctctgcgcttcactgagtttccttacaatcattattttgaattccctttcaggtcttttataaatttctttttatttggggtgtgttatgggagaattactatgttcctttgaggtatcatgtttcctttctttttcagatttttttgtgtgtccctaaagtgatatctgtgcacctcctctaataatcacttctaattttatagagtagctttaataagctaagactttttcctgcagatgtatttacagcatcgattaagtagagtgtttggagttttgggtgggagcagccacatagtctctgtgtgatttcttcagctataatcatcagcagtgtctgagatttcctcagtggcttaggctgcagttgtttgtggaggctttggtatgactttcatagtgatgaagatgaagagccaaacccaaggtgggtctgtccttgagcccaagtggcatgtatatggataccagcaggccctagtcacatcagtccttcatccccggggcagcaaacataggttctgggaagactagtccttgggcccctgggggttgtacttggggaatggcagtaacagtcaggtggcacatgtgatcgtatggcagtcccacactggaggtggcgaggtcgctattggacaaaattgggaacttgataagaaagaagagtgtagcaatgtgttttggtagatatgtaaatcactaaaggtaaagttcaaaatctgaaatgctccaaaatctgaaactttgagtatcaagatgacactcaaaggttatgttcaaaggaaatgttcattggagcatttcagattagagagatttggattagaggtgctcaacccgtaagtattatgcaaacattccaaaatctaaaatacaaaacacttctggtccaaagcatttcagataagggatattcaacctgtatattacaattatatattttggtacatagcatgaggtaagaatcaaattttccatttttcaaaacatttgatatttctgtgtcattttatataattaaccatctttctcaactgattttaagttacactttgatcatataattagtgtctagataagttatttctatttttctgggctactagttctgctacattattctctgtgctactgttaacactgctatcaccctgtcttaagtactatagatttatgatacgttttattcattggctgttcaaattatttttctccatatctaaattttgttcttttttttttttttttttttttttttgagatagagtcttgctctgtcgcccaggccagagtgcagcggtgtgatctcggctcactgcaacctccgcctcccaggttcaagcaattctcctgcctcggcctcctgagtagctgggatttacaggctcatgccattatgcccagctaatttttgtattttttttttttagtagagacagggtttcaccatgttgaccaggttagtctcaaactcctgacctcaagtgatccaccggcctcagcctcccaaagtgttgggattacaggtgtgagccaccatgcccggccctcatttatttctccacatgaactttagagcaatccaaaaggtctaaaaataaaatccatttgaactgtatttgaattgcaaggtaattgcaaatagattctgagagatttaatatcttgacaatttctgaacttccttatcataaacatggcatgtgtttataattattcaacttagcacagtgttcttcatacatgacctgtatattttatgttaagtgttaggtatccaaaggacatttgtactcctaggtattgtgtagaaactttgcctaattttgtatacatgttttataatcaggattttacttattttgtctttcattcagataaaaaaaattattaagcaactaaaaagagactgtgttaggcaacaaagatacaatgctagacaagatagagaaattccttgcctcaaagaatttaaggtctaatagaagtgactataaaataaatgacaattataatacatggatgtattagtgatgttatagtgaaaactacacaagaataaagaagagcaccctaactatgcttgtcaaaaataatccttttgggataaatacctaagcaaagcttgaaaggaaaaatgagtcagccaggtaagaaggtgggggtatgtgggaaagacacaacaatagaagaatagtatttgaaggtgtaaaggtgcaaaaactctaaaggcactgaaagacttgaagataataagaacagaaaatattaaacagaaataaatgacaccagaaatgagtcaggtaccagatcacataagatattttaagccaggctaagacatttggattttattctcacactaatgaggagccactgaagatttaagcacatgagacatcaggataactatattttaggaaaaactcaggctaaagaaggtggattagaagaatggcaaaaattacaatagaagggcaagactgaaggaagttacagtaatccaaacgaaagtcaatggtaccttcaccaagggcaataacaacagggaaggagagtgtggatgagttccaaaagttgattctgtagtgggaaatagactaattattgatccagcccaaatttgtctcttgaactccagacttgaataaccaactgctccctctcaacatctttatttggatgtctaatgagcacctgtacttaacatgcccaaaagcaaactcctgacatatacgtgcctacctccatatctgctctcccaactattttcttcagcttaaaaaatgggaatgttctttttgctattttcaagtcaaacgcttgaattttgctactattcccctcacgataatatcctatccatcagtgaatctagtcgattctaactccaaaatattcactaaagtaatcactcctcaccattgccctggctacaatttctctttttgtggccaacatattttttcacctggaccacagccggtttctaactagtctccttgctttcaggcttgactagctgtagtctctccactacagtgcagcaaatgaatcctgttaaaaacttagtggcaaagccttcccttactgccttatatagaaagcaaactcttcacctggtgttctctatcaccattgttctgacttttttctccttcaaagcacttactccttacatatcataaatttgatattgtccctcttcctccattagaagataagatccttagaggcagaaactttgattgtcactatattcttagcaccaggattaaagcctggaacacatcaggtgctcaacaaatatcttttggatggacatacatgtggtcacttgtgtgtatgtatgtatgaattggcagagtaaaagagaataaagaggatactcaggcttaagcaatcagatagatgataatgatgatgtttatttagataaacgatggtgatgtttatttaattcagcaacagttgaggaacaggtttggactagtccagtttaaaacatgttcagttacagaagctcttgtatatccacattagtcatgtacaagaggcagctggacatacagatgtggagaagagaaaatgggaatgatgatacaggtatcaatcctagtaactactccactaactgtcacaggttttccagataccatataacaacactttcatctccttattcccagaatttaaaacttgtttctggtcttgttgtattagttaaaattttcagatgaaggctaataaaaaagttagtaggattcccttccttaacctgaccaaatagcaatcctcaacttctcagaaaatgtatacattttattttcttgtctttattcttaagagcagactgtaactttttaaaatgtttacttttctcatcattatcagtatccttttacattctgaaacatttcgtagtctacctaaagaaaaacgtcaaagacacaagtaaccgtaaattttaaatcacatttactgaacccctattaagtactgcactgaaggctttctgtttccgtttcttatataattctcattatagtcatcctaatactactactagtatcattgtcatcatcatcatcacaataaggaaaaataacgcttagggtaattttaagcaataaatctgataaaagaatgatgaccacctgacttggactccaatattcttttcactatctatgaagtatgttaggtgtcacagtttaaaaaaaaacaaatacaagcaaccttcaccacttcaacctccaaataagacactgatataatttaaccaattctaccttttgaaaataaaaatgacaaattagactcacttaatttaatgtatcagcatactcaggatggtgagtatatacccagtaaggtaatcctcttctaccatcttcactgctatcatatagtcataggattgttgggacaaaggatcaatggaacttagatagtgagaatatggacaaagggatacaaagaagcagaactgcctaagagagaaaacaacagaaattttaaaaccaaaagagaaatacttttttgttgatatgaagccagataatgagtctattatacaaaaagattgatttggaaaaatctttcatattgagagataacaaaagttttgtttgttttttattttttaatgcaatcagggctgcatcagtggaaaaccagcaaaaatgttttatgcaaagaccactgataaagccgcacataaatgttggcaacaataaggatgaattaaaaacaaatgagaataaaggaggacatttagtgagaatgaagtttttgtacaaaatactatttctgctagccatgctggcaatacctctggtaaaatactagcatgcctggaggaagggcagggtcctctgtctgggaactcaggcctggaatcctgacaacaggttctacatcccagcctgccacatgctagtagctaaacctcattatggctgtgattgctcacctatgatatagggatactggccctctatgagtagttgtgaaaatgaaatgagatgataaataccttcatgtaaccctccccctgtggtgacaaagaagagtacgatcagagtccataaacacaatttagcattcaagagtaaagcacacttcaggctcaaacccatgaatcggtggagctactcttctaaagccagtacaaaatacacttactctgaaagactagattttctcaaatataacatgaaactctgaatcataaagtcagattattagtgccatctatacttgtgatctagctttgttgccattagagttttgtgtttaatcttacttcctagagatgctgtgtaaggctccatttttccaagagaagattaataccgttcaaaaactgttctgatcactaacacagcatatgcagcattttataagggttttatgtcagaatgaagtcaaagatgacaaaagttcctatgttgccaagagccatgaactgaaaaagtctcttttaattacattttctcttcattctttttctattttcaaagtttcaaaaatagtagcaaaattatgtaaagaatatcatttcaaaatcctttctttcatactaaattttccatttaaaaatcataattccatgtcacatggttatacatattattccagttcattttccattatgtactaatcagattgattaaaaatatagctttttaggagtaagatttcatataaatgttatcatacattatttcaccattgcaaaagaaaaaacacctcagaatatgcagtcttaaatgttttagtagtcagtataggcataaaaggtaataaaaaccagttttctctttctataactgagtattttaaatcagtaaatgttactaataagtgtttactctgcttttgttggtgctccctggttaaatgtatcttatgacaataggcacttaaaatattaagccttttaagtttttttctggtatgcctttagcatagatattattaaattttacatgttaatgtttataataaattacctttctaaatagactgtaattacactagccttaagagtatgaaaataagtatatctgaataaataagcaagcattcttctctatgacacagagagaagataataaattcaactcaactaaaaaaataaagtaagcaaaataatttacctagaaaatgaaaaacaccagtccctgacagtcttcaaatggggagatatctatgaattacttgcataatggctgttatttttctttgccttctaactcatgagattctaagaggctgataaagagtatcaaaatttgaaagatacaaatttttgaaccagaacggcccttcagtatggactttaaccacctcattctataaatcaggaaacctaagcagagaatataagctacatgctgaaggtggcacaaggcttggctatgagcagacctgagaccaggaactgaccaccacacagcaagcctagagcatcctctgggacatggaatttgcatgaggaaagcagtctgcaaccaagcacattagaaaggataactccccacactttgcatttacacttgatccaaattttcccttgctgtacatgttcaccaggacagttagtggaaactgaataggcctgagggagggaagagaaatgtttagtctccagaacacaataaacaggatttaaagctttgggaaataactacacagttgactcttgaacaacacgtgcttgcactgcacaggtacacttatatgcaggtatttttcaataaatgtagtcagttttccatattgacagactcccatttgcaaccaaacacagactgaaactacagtattctcaagaagcaaagcctgtggatatgcaaggtcaactgcaggctgggcagaaccaactttaggacttgagtatgtgtggattttagtatctgttgggttcctggaaataatcccctgcaaatacagaaggatgactctggttccaaaggaaaagtcaagaatgcgcctatcactacctctcaagtagtgggtaactttgctttggatagggttcagttattcagcaatatagtagaatggaatacacttgataaacttaaaggtcagaaatggagaataggcaaacgactgagaaaaaaactaaatttctgagagttaacaatataggtggttgataggacaatatggtttcaaagaaggtttaggtagctcaaaagcaaatgatacagaatacataggaaaaaaagtcaaaaaatttggaatgtttttatgagatggcaatagaccgttgggaaaatatcgaagtaaatgctttggtattgaaaatcacattgtataaatcactttagtcatatctggcttcccaaaccaagttttaatatttctaggcacataaataaatgggtgtgtacctaactacatagaaaataatcagtggagaaacagataggctatttttctattcaaatactaatatatgactgccataactaatcaggatattttactagcaaaaagaagtctgtttgacaattcaaggctaagaattatataatatataggaagagtagctgaagccctaaataaaattttgtgaaacagattatttcaactgtagcaatcataaaaaatgtagcagataaatgcgtatttctctttctgtgacattctgttttagcagacaatgtcacaaaacaaacagtcttgaaggtcttttttctgcaagtcaagtcctacatggacaggaataagaatctcactacttaataaacccttcattatgggtatatctagattttttttagccatagtcatatgtacaaaagaactgttaaagtatcgggaaataccttgttaaaaaacttaaagtacatacctcaaaacaataaagatttttacaaaggctacctaaagaatgcttcccctacctctttaatcctatatgaaattaaaaatcaaaatatttcataaaaactgcttaatatccaaggaccttctaaattataataattagcaactttgctcatctcaaaagtacgacccctacaaaaagaaccattttattgaggtctccttgggtataatcaccccctcataaccaaagatttaactagcagaaaaacaagagttcaaatcaaataaaatattaacaccattcaaaataacagatgaaacaactttttaaattcacaagctgtggattagggagaaaaataatcctgaaaagttaagcctatctatcacatatatcttagtgttaactgggttcattacaatttgagatgagctctgactgaatagatctaaggactgagagaagaaagtaaaagatatcaggaaagagagttcaaaacccgactgaaggaaaactgaatcctgttctaacatcatctatcttggctcatcacaacttctccagaaaacatccataaatttttatgtgccctcaaaatctcaccaccataagaaatacttctagtatctggcccctgtgaattcttcttgaatgttggtgtttcccagtcatggaatcatacatgtatattcataaaaattaatttgtccagctgggcacggtggctcacgcctataatcccagcactttgggaggctgaggtgggcggatcatgaggtcaggagatcgagaccatcctggctaacatggtgaaaccccatctctactaaaaatacaaaaaattagctgggcgtggtggcgggttcctgttgtcgcagctactcgggaggctgaggcaggagaatggcttgaaaccgggaggcagagcttgcagtgagctgagattgcaccactgcactccagcctgggcaacagagcaagactccatctcaaaaaaaaaaaaacataataataataatttttccactatttttacgtataacattctctcatatgttctctgatggtagaaatatatctctgctagaataaattacaaaaccaactctgaaagttaatgtatgacatacgaagacatatacaaaagaaagtacaagagaggagaaaagtcatgagtgagaactcagtgtacattcctaatttagaagaactaaatccaaatgataacacaggtaattcaggatctctagcatggtgtcgaatggaaagagttgataaaccagcttactagtatttgtacacacaatgctaagcaacttgagactagaagaagtaacaatacattatattaacaaacagataaaaagcaatgccacattaaatcataggcagaccatcctggcatattcctggggaaaacagaacacaatcatcaaaacagccagagtgattatccaaaacttgatagaagagaagtgatctgacacaaaaatgaccattattccaaaatactgaaaaagaattgactgacagcaaaatggtcaagcttaagtagtagaattttacaataaacttacttctatatttgatgacagcatgcctataattttgtgatcttgttttgggaggtggggaggcaggggaggggacgggaagcaaaaaaagaaagaaaatgctttattgtgtggggaatggagtgtgggtgtgccagggtagaaaagaggaggagaaggtagagacaatacctaggtatttgttcaactgaactcaacttttattatctggactttctgatacgtagttatcctgtctctctctctctgcttttacgttcttgtttttgatagctcagttgggaattcaagtcacttgcccagtttctcagttattaaatctttatttctctgtgctctaagaataatgccccagttagcattccagatcattctggtctccaattggtctagctaattggagttccattatttgcctgatctgtgttctagaataaactattctgtgctagtttctgtccccacaatctcctgaatttggaatttttattaatctgggctgttaaaatttgtagttctatgttatcttaccttctggctggagcttgtgttgtgtacatcctatatagctatttataacacccggcttgcagtggcacaggcctgtaatctcagcactttgggaggccaaggctggagtattgcttgaggccaggatttcaagaccagcctgggcaacaaaatgagtactcatctccacaaaaaacgtaaaaattagctgggcatagtggtatgtacctgtagtgctagctactcaggaggatgaagtgggaggatcacttgtgcccaggagtttgaggctgcagtgagctaagatcatgccactgcattctagcctgggcaacagaggcagaccttgtttggaaaaaaaaaaaaaattaataaaatgcccagctcacatacagacctcttttccactgtaccatctaactgcaacccaaatgttccatatacacttccctagtagtataaggaggtgaggttaaaggaagactagcaggattcattttatattgtgattagaaaatgatatttttaaaaataatcttcctgagagagtagagaatggggagttagtgtttaatgggtacagagtatcagctggagaagataagttctaaagacggatggtactgatggatgcacaacgttagtgttgctaatgccacagaactgtacagttaaacatggttaaaacggtaaaattttgttatgtattcttaaccacaacatttaaaaatagaaaaaaatttctttatgaggcttgatttcaaatcactcattttaatttgacctcttgatttgaaaatttatgtaggaatcatgtagttaaaattttgctttgtcaaatgaagaacaaaaatctaagtggctgtaaaattaatcagaccaaactgggatcatttaaaatgtatacgttctttcccaagaggtgttcaaaggcagagttggtccttattcactgcacacctcaaacttatacattggtttgactatttatataatgatatagataatgctgttacaaaataacgatttctcttctacctctcacccagattacctctccaaattgtacaaagaatttcattcttgggcaattcagtgtttcaagaacctaatcgcatttctatttccttgaatacccagctctcagatttctaagcttatagtagcccatatcaattactccgtcattaaaggtgcatagtgataaagccagggcagacttttacatgaaaggaagatcttcatcttttcctacacagaaactgactctcttcagcttcttgttctttgtcgcataaagacaggtggcacatggataatgtatagaattagattctggaaaggaaacccaagccatccttatgcttaaaagcctcaaaccatttacccaggaccagagaccagggagatgtatttggaatattcagacaaaagccaagttaacaatgaaatggctctttatctaggtttgttgtggatccctgtatatacatattgacttatattgactaaggcaaagtcaccttttattttctagttaaacaatacatatgtatatgtatctacagggagaatgaggcgtgtgtgtgtgtgtgtgtgtgtgtgtgtgtgtgtgtatcactaaggaatcccacaggaaaaatggagagctaagccaagtcaggattcagaaatccctggatggtttataatccttcaagccccaacaaaaactccaaagaatataaaataagcaatactttcatccccttgccaatgtccatatttaaagttaggctacttataaaatgaaaatctcccaatgttttcgagcctgcccccactcccctaaacaatcttaccttcagtgtaacaaccaaatctgctattaaaaagaacgtacttaacagagctgtattgtgaaatggggagcgaggtaacctttcgttaatgggaatgcagtggcttaaattgtattagaaatctcactttaaactcaattactttacaattatgtttggccacctgacacttgggcagagaagaattaacatcttagtgaagaagaatctttacaagaactgaaatatcccttactgtaaactccccaacctaactaattaaaaactatctttaaatgcttcatgaaaatgtcagaaagtaaaagtttttgttcaaaagacatacaccaacaagccaacgcagaacagaacaatactaaacagaatacctctgacatccaggaacacctattaattgggactctggctcatgtcaaaatttctaatctctaaaatgtttgaataaatcatattcatatgcttaagactattttacttcatgttggaaacatcaaatctgtatttcatataatttcttgaatttctgtaagactcaaatcctttttttcccaattaaaatggacagtgggatattatctaatggacagtggaatatcatctaattaaaaaaaatctccaataagaaaccattatttccaataagaaaactaacccataagaggctaagggcctggcaaatgaaaatgaggactctggactctcattcttgtgctgatgccatcctggccattcaaagcctatctagcccatcagtagaaactgcaaatgtgatgacagaagaactaaatgaaattaaaagcagaatgactaagattcattctaccctgcagagaaagtagagccagataataattggagatgataactggagattaatatttttctttcctgaaatttgtccaatagccttgccatttcaggatcaatggcatttatttcctctggggagaaaagataaaccctagaataagaggtcattcctgagcactgagtataaaattagatttctgttaatatctacagtgagacaatagtcttgaaagctatgtggttcaattgcaaaagctggttacttacaggaaaaaaaattaatgcagtcacaaaacattcctttaactatataaaactgagaatagggccctactataaggagtggctaggaaggatgcagcacatgagaaaaggacagagtgtcagacatagggaagacacaaaagcccttcctgggccaagagagaactcgcaggggatcagaaggacaagatcagaattcatatacacctctggagggtgtgctctcttcctcctccctcatggtgcaaggctgaaggagagccacctggggagtaactccaaagaataactaaataactaaagagatattagagacccccagagcagagggtatttgtggccagcttcctgtctggacctccacaggaagaccgcctcacagaagcctctaccaatatggggcaagcgctagagacaaaaatagtgcatagtatgtttagacaagtgtgcttgtgacaatatcttgctttgtaagtggttaatgggagatgtaaaagcactaaaagagtcagcggacatattttcaaaaaatatttactacgttgcactagatttttcaagtaacaactgaaaaattctcattggatataaaatcccctgcaactcaattaggaaaaaaaatgtatactagcagcaaatatcatatttcatatttcaaagaataaggcagcaaagaaggatggcaaaaaaaatctatttcttcccaatatgtacatgcaaaggcccaaaggcattataacatataaaacacgtatttctattgacctatgtaataccttatctcaaattatcaaatttaacatcttatccccatacttagctcttttggcttagtttcccaaatactcataatgatttctcagcttttcacaagctgctccttctaagcctgaagaagatatatatgatttttcacttcatcaattacttccatcctcaaatttgagcaaatattcttcaggataaccattatacagatttccttcattacaaatgagtgtcccttttgatcacaggcaccatttggaataattaactatcaaatatattgctttctgaatggagtttattgaattaatgtaaccctgtgtatgtaatatacttgacaaaaatttctttcactttgaaaagctaaggtcatttctaagctgtaactttaaaaataaaacaaatgactcacagatcttgcaacaatttttttagattcatttatattgactaaggcaaagttgcctttttattttctagttaatacacatcaaaatatataaggatttcaaaaaaatctaaacatgctattccagctaattgccatattattctagatttgtcccccaggaaaagatattgactttttaaagttcattgtgaaacaattcaaacaatatagaagtacaatttttaaaaagtaaagtttccccacacattaatacaaatattccccaaaggaaactattgaaatgatagttattgttaacaaaagctactgctggtagccttctgaaaggctacacatataagtgtataagggtgtacataaacaaaaaagatgtatacacatgtatacaaatatacaattgaagggtttttttccttaattaaatgagctcataccatatacattattttgcattttacttgtttcacaaagcaataaacccagtgtaattttccatgttcatatgtctagatcaacaacatttgttttaacagcttcatagcatatcacctggtaccataatttggctacatataataatttagctattttccttattaatgagcatttaagttgtttataaatctttgctatcaatattactaaaatattcttgcatatttttccatatatatataagcatttgttgcatctacttttaactgtgccgatgtaataatctcgttctcttatgagaaaagacatatgatcaatttaacaccgttagcacatttcctcttctatcgagtctgaacaaaatgggctttctggtttttaaaaaaagtttattttggcagtttatttcttaatgtcaacgaagatcagcagtttcaaagaattgtagaatgttaagctaccaagaactcttattttatagatatgtaactaaggcctggagaattgatttctccaaggcacacagctacctagtggtagattcaagacaagaaatcggcttcctgcttctagaccactgttactgtaccacactccatttcctggggaaggacgaacacagacacacaggaccaagaaagccctgttagaacaataatagcaactggaaatgtaatagctctcaatatggagctcctctgagggcttccctgtcatgataaagaaaatcttaatctatttcgttcattcattcactcactcactccctcccaaatcactgagttaggctctctatagaagaatacagaaaagtcaaatgttaaggcttgctcataaagaatctcggttgaaattggaacaataagatgtgaagatgtgaagatctattggaacaataagatgtgaagatataaaattatacaataacataatcatttatataaagtgaaaagcattacagagttcaagcaaattctgatatttattctatcagaagcccagtaaaagtttattaaaaggatagtaaatttttcaatgaccaaaggctttgattggcctcaattatttgaggtctcactaatacttattaataataacaattactactatttccttgaggccaaccaagggaaaagatgatggaggctgggcacggtagctcatgcctgcaaacccagcactttgagaggtcaaggtggaaggatcacttgaggccaggagttcaagaccagcctgggcaacatggcaagaccatgtctctacaagaaaaattttaaaattagctgggcatactaactcatacttgtagtcccagctacttgagaggctgaggcaggaggatcccttgagcccaggaattcaaggttgcagtgtgtgataatcatgtcactgcactccagcctgggtgactgagcatgacactgtctcaaaaaaaaaaatgatggaggacttagaaagttaaaagaggcaataacatctcagtagatggaccaggaaaatcttcacaaagtaaatggtattacatgtaggccatgaatgattaacaggggacaaaactggaatgcattcctttcctctcttctctatgaagagctattttccaaatataaatatatgcatttgtatacatacagagaaagaagcaaactatggctctgaataagttttccatacagtgtagaagaaaatttgactaaaatatagatgaatccaaaagctttaggcatttgcagttttattttctggaagacaactggagaataggaacacttgtttcaaaaattatcacacataaccaatcttcacaaggaagcagaatcgtaaggactcaaatttggaaagaaaaattgatagatttgacttctactgctacccataccttgtgtacaatgggatttttgatagtttgtttaaatatatacatttattattaatgcatagttgaattaaaaactactatgtttaacactaacttgtttctagcaacttttctgtgtgttagaaaaaaagggggggggctattatcctttatacctccttttagaaccttttagaaaggagagaggcaaaacatgtggaaagaacttgcccttagtaatcaatctttccaggctcataactggccactaactaacttgtaacaccaccactccctcttgcgggccagcaacaccatcatcaacatctacataactatgccctaagctaggggtatttcaatattgtaccaatgcttcctttgcccctaccactcctactgctggattggccctcaccttcctccctgctttcaaaaatcatatactcatgcttcaaaacaactcaaatgtttctttgaagattttccaaaaaatccacacctcaaatctcatctcctgcccttgtctccagtcacactaaacttctgatggatcctagatcacagattctttccaatctgaggaccttccatgactatcctctctaaacacacccctcatcataccttgctcatttactttcatagcacattcaaaaactacagtcatttttgttggcctatttattttctgtcttctccattagattatatactataggaaagcaagaagttatctgctcagcactgtatcccaggagctaggacagtacctttcatgggagaggcatccaatgttatttgctgcttggctgaataactgttcagctggctgcatgatttgccatgatggacccagtaaccaaaacgagagccctgcttactgatagcagatagctgcaatcctaggcatagtactaagtagcagctagccttgagggaatatgacttgtatatccaatttcacttgctgacagaaaaaaaaaaaaagccacactagcactaagacttaagcacttaatacaataggaatcacagagctctgagaagaaatagtccttaagcacaaagctgctgggctaggaaatagggaggccctcttccacagaggaatattgacatgagaaccagggtcaagaggtacaggtgagtatttctgtcctgtttccttcatgactcaaggttaatttacaagtattttccataacaattataattttaccaaaaaaagattaaaaatctatgaattaaaatttaaatgaaagcttcacatattaaaaatatgcttacgaagaaaaaatgaagacgaacactctggcttattactgaaagcttatacattaagtaggcagtgagttacagagagctgtctccatagtggacataaaaaataagaaaatatttctcaatgatcaacaaataacccaaatatgtcaaatgatatctctactggcaacacttttatggcttccatacttagcgctcagatttttttcatctattaaatgagaaaatgatagctatgatctagtaactttacaatcctatgatgattgaacaatcttccacttttttgtacttctgttacatgttgcaaagcattgtgttcctattatattgtcctttcagctaaaatggttaagtaaaaacaaatatttgcacaacattttacagtttacaaagcacagaatccagtttggatacaatgcaccaagttcaagattattaatgatggggaaagtgatgagagaaaaaaacctcccgaacactacctgataccattctttacattgttcatttcttccaaaaaaagagaagtatttgaagtttatgctcaatagatagcatatgaaacacaatgttcacaacaataaattttaaaagttcctaaagagtatatagacagctaatttgaagtagcacacaaataaacaaatgctaaaaaagcacttgagtcatttaaaatacatgcaaacacacaaagagaaacaaacatgttgctgatgagtactggcccatgcttacctacttagacagctattgtgtacaatattttaattcaatcatacttaaaattgcaaagttattcttctaaaaatgtaagtacataacggatatgttattttttttaactataccaccactgccaggcacaactttaaaataaaatgtaatacaaaaatgagaacatttgaaaatctggtacgataagggaaaaaaactcttaagataaaatggatgctgaagtgttgagttgcacccaggggtcaacaacattgtgtctattattcagctgaaacacagaatttgcctttagataccattttaatgttaaatcaagaactgtcaatcagcaccatttgtttgtaatccctcatcagaacccattgcctcagtctgaacattcataggaaagaatgcagagggcatatctgcaaccacttaaccttcatcaaccaacattcatgcatgctcattaacatttttttcatcccactttcgagcatgacacagctcataccggaataataactcgctgataattgttctagacaacagctggacaggcagagtgcagaggtgaacattctcatagattatggggtactgtaatgcattacaattagtaaaagagtcacatgttcgtgttgaatagctttcaacagaagtgaaggaaatgtcattatcacaaacagcaatctcctctaactttaactctgcatggtccaccgcctgattctcttaacgctttcctattttgaaataaaccaatgaaaaacattgaccctgttactgtactatttcatgaaaagaagtaatatttttgatgtgttacaatcagacacgatctaaatttgtgatttaatttaaagacagaaaagcaggaggagggagaggaggaggaagagaagagtttcacatcttactaataacaattgttttgagcatgatggtgtacacctgtagacccagctactcaggaggctgaggtgggaggatcatcacttgagccccggatgcggaggatgcagtgaactgagatcatgccactgcactccagcctgggcaacagagcaagactctgtatttaaaaaaaaaaaacaaacaaaccacaatcgttttgcatgaagtcccataaaatcattatttattatttttgctttaaactgtcaattcagaaaaataaattaatatcactgaagaaatctggaatatcaataaaaaaggagtcctacatagggaagggaatttagaatccagtccaacatcctattcataacagctttgatagctacttctttgccataatgcaataaaaataaaatggaattaatatgataatgataatactagttgccatttttagagtaatgtgagtcaggtatcataccaggcactcaacagacacagtctcttaataatcctaaaagtagtattaactctctttttcagatgagaaaattaaagctaatctgaaagagactgaaaattcatcccaagtcaaaacattatggagacaggattccaaccaggtagtctgattccaaagccgatgcttttcacctggcttcatggttaatttccacattagaatcttgtttattttccattatttcatcccaattccttggctgtacaattctttgactctgtagaattagacctatttctagaaggtctttattccaagacatagcatttatacttccacattttctactctccttgtgtccaagaaacctgctcttaacactcagataatctctagtccctgtacgtctacctagtttccattacacttagtttttgttgttgttgtttttagagatggggtctcacttggtcaccaaggctgaagtgcagtggtgtgatcatagcttactgcagcttcaaaactcctggcctcaagtgatcttcctgccttggcctcccatgtagctagagctacaggcatgggtttatcaggcccagtgtgttttttcgtatatatgttgggtgtttgtttttgtttttgctatattgcccaagctggtcttaaactcctggtctcaagcaatcctcccaccttggcctcccaaagcactggggttgtaggtgtgagctacctcaccagcccatgctttagattttctaatcaaacttcttaatgtggttctttctacaccctttctctgccttgcttgacataaaaagaaagaaggaaggaaggaaggaaggaaggaaggaaggaaggaaggaaggaaggaaggaaggaaggaaggaaacttcaacaaatttcatttaaagatctaatttaaagatcttatacatgattcattaatcaggtagcatctcatctaaaaatgtagaaaagtgccacaataaactgagcagagatggttgattttatagctagagaaggggtaaagaaagcaggaagaaggaacaaaaaacagactggtcatttttgagttactttctttatagggttaaaacaggggacttccttatcatataggctcaggtaaaataggccccttctgattggctgctgcgaatctcctatttttcagaaaactggcacatgttaaagttcaatttgattaaatggcacctagcacaagtgactccattctggtttgatctggcatgttaaggccaagtgcaacagcttagtaaaagacaatggcctcccatgaattttgtttagcaacatttagtcacaaatatctgggagaggggaatcaagaaacctaatagatataacagtctatatctctagtcctacttgtgattggtgctccttgttgaaggaaatcacatcacctgcaatgggatctactataatttaataatataatctgaaataaaacctcagtaatataaccagggtcagcaaactatagccccatgggccaagaccagtttgctacctgttttaataaatgaagtataagaggaacacatatatgaccattagtttatatagagtctgtggctgctttcacactgcaatagcacagctgagtagctgtgacagagaccatatgacctacaaaaacaaaaatatttactattcagtcttgtatagaaaaatgtggccaacttataatctgtagtggagatccataacagtatcttgagtcaagcagataacaataaaacctatttatctttagcctaaaatctacagacaccagcttgattcactctataatcctaaatcatcccatgctctgctttcttcccaaaatctaccagctaatgattgtctaaacctcgtggatcacacttcctcaaagagcttttatagctaatgtactcccatggaagtaacctagattcataaattcatcaccaatgcccttggtaataaaagtagtctcttaattgacattccagtttctggactttacctactgcaacacagagctgtgtgatactaaggtgtcatgctaaaacatagattataatatgttatgtctccatttaaaactttgtgacaatataatattttaatttatttataaacgtgacagaagaaaatataaatgcctagattttgcatataaacctccctaatgtaaacacaactctttctaggttcatcttccagtgacattgtcccatatatatcttctcattctcaaacacagagcagtatatttcactgctgatctttagctcccaagcctacgtgtttccccaaacaccccagcagcacatgtttcagtgcctttgttcacactcttgacttcctctccttatttgtacgttcactcatccatccaacaagcttattaagcaatgataaacatcagacactgccctgagtaaaaggagtagagtaggcagaagacatagttcctaaccactcacacaactaagaattttagtagaattacaaaccagagctatgaatgaaaaataaagggcactgtggggttgaatcacaaaacctatgccaatctgagaagtcatagaaatcatttcccaaaggagatgacacataagccaagaaatgaagtatatgaggtgggcaaagtgaagctatctccttcatgatacttttctaattatcccaattaaaatcaacaggtttttaaatatacttaatagctgtgatataatgactaaatgtaatactatacgatcagtcaagatatgaaggctatttaatagcatgagaaatatgtggaaataactatatatatatattgttatttactctagcagtataaacactgctagaaaacaaaagttttgaaaagcttaaaggaaatttaaattctacgatgaaattgaatagtgtagtggagtttagggtggtatttttttctttcatcaattttctaaattttctgtaacataattattctataatgaataaattatggcagcttaggtaaacaagctttatataatcttaatgaaatacataagtaatgttttatgtgtacttaactattaagacactgatgaggtttggttgcatccccaaccaaatctcctattgtagttcccataatcctcatatgttgtggttgggacccagtgggaggtaactgaatcatgggggcagttaccctcatgctgttcttgtgatagtgagtgaattctcacaaggtctgatggttttataaaaggcattttccccacttcgctcagcacttcttcctgacatcatgtgaaggacgtgtttgcttccccttctgctatgattgtaagtttcctgagacctcccaggccatgctgaactgtgagtcaattaaaccactttcctttgtaaattaccctgtctcaggtatgtctttattagcagcgtgagaatgaactaatacagacatacataatactgtatactgtattacctataacacatatatctttcatgtaaaattgcaagcttctcagtcatatttatgaatcttctgccatcattcactcaataaacttcataattaaatactattttgatcttcatatttccctacttaaagactttattagtttctataataggcattaatatacttgattttctgttatgtcccatcaaacttttataaaagcatcactttcagtaaaattttgaggtttttaaagcttaaaatcaacacctataaaaaattaaaaataacaagtgtgggcaaggatgtggagaaattacaactcttatacattgctaataggaatgtaaaatgattcagctactgtggaaacagcttagcagttcctcaaatagctaaacatagaattaccaaataatacagcaattccaatccaaagtatttatccaaaagaattgaaaacaggtattcaaatacatgtacaccaatgttcacagcaacactatccacaatagccaaaaggcagaatcaccctaaatatccaccagtgaatgaatggataaatcatggtataaaactacaatggaatattattcaaccattaaaagaaacatagcactgacacatgctacaatgcatactcaaaaatattatgtaaagtgaaagccagatacggtaagtcacatattgtgtgattccactgatatgaaacatccagaacacataaatttataggcagaaaacagattggtgattgccaggggctaggggaagtgaataatggggagagactgcttaaggggtccagggttttactttggaatgatgaaaatgttttagaactagatagaggccgtactaaaagccacaattattcatagttaattttatgtgatattaagttttatcacaatttaacaaaaatcaacaccaaacaaaggagcaattttcaggaaaaatacctacaaaatgtgttagagtatgtttgctattaattgctcctggtttgtagacaccaatcagggtgcatccaacaacaacacagaatttacctataatttttactttcctccttcttactttttgctgctaaaacagaaggaaaaaaaaggtgaatcattttagcatctaggtcctgaacctattccactcccaaccaccttcattattctctgaatttttttaacctaatttacaagagtctgctattcactcagagctaaagtcatcagaggcagagttaattggaatctagatcatttaaatatttctactccccttccaaaatttccatttgcttaaaatgaaaaaagacagtttgcttgaggaggctgaaattattgcatttctgctttaaagaaatgaaaaagcattcatttatccagcaaacattcaatgcccatatgtgccaagcattcttctaggtgcttgtgatacatcagtaaatgaaacaaagagctctttagtaaaggagcttaaattccagtgggagtagggagagaataagacaacataccgaatatataagtagctaacagtatgttagaaggagataaatgacatgaaaactacaacacagtagagaaaatggggatggcgtgaggacaaaggaaaacatggcaggattaatttgggagttgagcatgggaacctcattgagaaagcgacatttgagttaagacttgaaggtggtaaggggctcatggagcacatatctggagcatgaatgttcctggcagggaaaagcccatggcaggagtatacctggcatatctggggtacatcatgaaggttgcccagtatggtagaagtgaaagaattgaaagagaggtaataggaaatgaagttggcaagccaaggagtgggagaataaaatgtttccagaagcttcagcattttccagatactgagaaaaaagggctcaactgtttgaaggtagaaagagaactacatggaatgtggaggacaggggcagaatccaggtgggctctccaatgcctggtgaaagacgtactctaagtcagtcagccacagctcccagaaggaaccaataggaattttggtaggagataaagaatgggtaaggattacaaattaaaacactcaaggataaatgatgaggacaaaaggaaggggcaatgaaatgcaaagccaaatttagagaaaaaggagaccaatgttactggagtaaacgatgtgtagagcagaaaagtaacaaggagaaaatagctagatacacaagttagacctgattgcagaaggctacaaatgccagactgagaagtcccttttctttttaatcttttcgtatgtgtgcatacaaagtatatgataaatgggatattcctcaggaccataaatctgaagatagtttgcattattgtctttaaaaaagaatatgaatagaaagagcaatttggaagctatttttttaaagaggtatttgaagaaagtatgtaataaatgaaaggctatcgctgtttctaagtgtcaagaaacaaaataaggcaaaataggagatgtaactgtgctgtataagtagtcagggttcctgacaccaaggtccattccataccaatgcataaggtccttcaagatgcacctagtatgctctcatgcctttccctccctcctgttctctaatgtctgtgaacaggatagagaggaaagaacaaaagttatgaagtcaaaaagtaaattcttgattttcaactcctttctaataatgcaaccttgacagacagagttttaacttttgagtctcaccctcttacattaaaataaggcaaaagcctaaattacaaatgtgaggactgggcaccatccctggggttattatgcaaggcactcatttttcctttaacttgtaagttacttcctttatctcattcccttttgcttctaacagctgctctggccttataaccccaatataatcaaaaataatgataaaatttgggttattatggttgtaggacatgcttattcatcaagaacacattcacaaaacaaccgtcttaataacggatacctcagagatacaaaagtggacaggggatgaccatgtcaggtggttagttgacttctctggattcaactctcttattaaataatataggtgtgtattagtccattctcacactgctataaagaactacctgagactgggtaatttataaaggaaaggggtttaattgactcatagttccataggctgtagagagggcatgactggggaggcctgaggaaatttatagtcacagcagaaggacaaaggggaagccagtacatcctatatgactgaagcaggaggaaaagggagtgaaggggaagtagctacacacttttaaacaaccagatctcatgagaactcaatcatgaggcagcactaaggggatggtgctgaaccattagaaaccacccacatgatccaatcacctcccactaggtcccatctccaacaccagaaattacaattcaacatgagatttgggtggggacatggagacaaaccatatcaaggtaataacaaatgaaataatccaacgattactcaactttagattttctggtttatggaatattctttcatatatatatatacatgtatatatatatatacatgtatatatacacacacacttttatatatatttgtatttgtatttgtacatatgtatttttatatatgaaaaattctattataaaactattactactgatatgctttggctgtgtccccaccaaaatctcatcttgaattctagctcccataatcccatcatgggagggacccagtgggaggtaatcgaatcatgggggcgggtttctcctgtgctgttgtcatgatagtgaataagtttcatgagagctgatatttttataaagggcagttcccctgcacacggtctcctgtctgccaccatgtaagacgtgcctttactcctccttcacattcctacatgattgtgaggccttcccagccatgtggaactgtaagttaattaaacttctttttctttatgaattacccagtctcgggtatatctttattagcagcatgagaagcgactaatacagtaaattggcactgcagagtgggcgctgctgtaaagatacccaaaaatgtggaagcgactttggaactggataacaggcagaggttggaacagtttggagggctcagaagaagacagaaaaatgtgggaaagtttggaccttcctagagacttggagggctcagaagacaggaagatgtgggaaagttcggaacttcctagagacttgttgaatggttttaaccaaaatgctgacagtaatattgacaataaactccaggctgaggtggtctcacatggaaatgaggaacttgttgagaactagaataaaggtgactcctgctatgttttatcaaagagactggcagcattttgcccttgccctagagttctgtggaactttgaaaatgagagagatgatttagagtatctggtggaagaaatttccaagcagcaaagcattcaagatgtgacttgggtgctgttaaaagcattcagttttattcattcagaagatatggtttcaaattggaacttatgtttaaaagggaagtagagcatagaagttcaaaaaatttgcagcctgatgatacaatagaaaagaaaactcattttctgaggagaaattcaaatcagctgcagaaatttgcataagtaatgaggagccaaatgttaatcaccaagccaatggggaaaatgtctccaaggcatgtcagaggtcttcatagcagccactcccatcataggcccggagacctagaagggaaaaatgatttcgtaggcgggccagggccttgctgctttatgcagtctcgggacttggtgccctgtgtcccagctgtagctaaaggggcaaaggtacagctcaggctgttgcatcagagggtgcaagccccaagccttggcggcttacacatggtgtcaggactgtgggtgcaaataagtcaagaactgaggtttgggaacctccacctagatttcagaggatgtatggaaatgccaggatgcccaggcagaggcatgctgcaggggcaaagccctcatggagagcctctgctagggcagtgtggaagggaaatgtggagtgggagcccccacacaaagtccccactagggcactgctgggtggagctgtgagaaggcagccactgtcctccagtccccagaatggtagatccactgacagcttgcaccatgcaccaggaaaacccacagacactcgacaccaccccatgaaagcagccaggagtagagatgtaccctgcaagaccacagaggcagagctgcccaagaccatgggaacacacctcttgcattagtgtgacctagatgtgagacatggagtcaaaggagataattttggagctttaagatttgactgcccagctggatttcagatttgcacggggcctgtagaccctttgatttggccaatttctcccatttggaatgggtgtatttacccgatgcatgtacccccattgtatctaggaagtaactaacttgcttttgattttacaggctcataggtggaaggaacttgccttgtctcagatgagattttggactgtgaacttttgagttaatgctgaaatgagttaagactttgggagactgttgggaagacatgattggttttgaaatgtgaggacgtgatatttgggagggaccaggggtggaatgatatggtttggctgtatctccacccaaatcttatcttgaattgtaactctcataatccccacgtgttgtgggagggacccagtgagaggtaatttaatcatgggggtgggtttttcccatgctgttctcataatagtgaataagtctcacaagatctgatggttttataaagatcagttccccttcacatgctctcttgcctgccaccatgtaagatgggcttttgctcctcctttgcctgtgccatgattgtgggtcctccccagccatgtggaactctgaggccattaaacctctttttctttataaatacccagtctcaggtatgtctttattagcagcatgagaacagacaattatagttaccatgcagaagctgacacaaactgccgtttttcttgctattagtactgaaaaactgccgaatctgcaaaagtatttaatgaaaacacaaacaactggtcaattttaaaatgtatttatgtatatacagatacagaagatacaaaatgaagtaaaataaaacttgggaaagtaaaatattcagaaaaagcctaactttaaaatagaaaaacataaaatctctaaagactaatacccctcatttaaaaacaaacacaattatcccattggctattttagctctcctgggttgaatcttatgctagggaaacagaaagccaaactgtcccactgtgacctgtgaaaccctgaaaaataattggttctctaatcaaaaagaaaagaagattaaaggagaaagaagagccctgcttcaggaagaatgagtctaaggtaatatgatgatagaagagtggactggaaaatgactaagccaacaattaaattaaaataaattgcttattttgtgtgaaatgtcgctgcaatagatcttttgataaatgtgatttccctcagtgataaaatttttccaattaaaataaactttatatactgtatttttaattatccatttaaatatgcaattataataacatatattttccatgttgtgataaaattatatatattcatatccattattaggtctgcgtaacatttgaactaggaaaaggtctctattgccagagtctctatcacatgaacagaaatattcaagtaaaaatatgttgtgaaacatcataaaacaagagtaacaatctgtgttttaaaataaaaactttaagataaggaaacttagtttatcaacaggcaatgtagacattgttatcttttaaaagttaataatgtataaatcttttctctagattagaactagtttctctttcaatcttaaatagtagtgagagtcacaaaaaatgtttttaaatgccaatggctctttaggtttatagaaagtatttccaggtttaaaaacatatatgaaataaaaacatatataatttaattatttcccagaaaaaaatgaagttagtagtatatattgtaaactgcaaaatatataatacactatgatacttgatgcacattaattaaatataatattttgaaaaggaaggggaaaaaatctttcctggtacttaagaaaacacaatataagaatttttcctaaaaatctagaaaggcatttttggctgtggtgacaaaaacatatgttaatgtgacttgatatagatctaaacttcaataaactttttttttttttttttttttttttgagatagagtctcgctcctgttgcccaggctggagagcaatggcacgatctcggctcactgcaacctccgcctcccgggttcaagcgattatcctgcctcagcctcccaaatacttgggattacaggcatccgccatcataccctgctaatttttgtatttttggtagagatggggttttaccatgttgaccaggctggtttcaaattcctgacctcaggtgctccacccacctcagcctcacaaagtgcggagattacaggtgtgagccactgcacccagtcttcaataaaccttttgtgaatagaataaatgatttaagaagttgagtcaaaatgccccaggactcctaaaatggccttcctataaaaggaatgcaagctaaaagaaagtgacataacacaaatatgttcatttaactgtgaaataagaaattttatggcatagagttgttccacagcctctgctgccaaagatatcaatgccctaatttctggacccagtggatattttaccccacatggaaaaaaggaactttgcacatgtgatcaaggttaaggattctgagatggggaagagcagaatggattacccaggtgggcccaatttaagcccgtgtgagtctttaaaagaaccttttgtaacttaggtcagagttagagaaggagatggaatcatggaagccaggcgagagagatctaacaaaatgacttgctcggctattgctggctttgatgatacaggaaggaggccacaagctgaggaatgtgggtggcctctagcgactggaaaaggcaaggaaacacattcttctccagagcatcaagaacatggtcctgttgattttagattagtgagacccatactggacttatatagaattagaagatgataaatttgcatttctaaagctgctaaatctgtagtaatgtgttatagcagcaatagaaaactaatacaaaggccatttgtgagcataatgattcttcctgtctctagctaagctaagctgaaattgaagggaaaactaggaaaaatagatgagaagctaacctagagttctcacatcactgggatattgaattaaccaattctaggaccaccaaccaccagacttcttgttttaatcattccctgcaggcaaatttcctcaatgattcacaagacaagactgatttatatacactaatacagaatgtaaaattctaaggtttttttccaatcacagatttggggggctataagtcatattctgagttgaataattttcacttcaagagttctgtcctcctcatctattacctgtgaagctagtagggaagtataaatattcactttcatttaagctaaaaactaaagacatttctttatgtgtttccttaataatttgtcaccagtttaggaaacaagtatttagttgaaccgtgtgaaggctgcgattgtcaaaatggtataatggcatatagttcactcaactaatttctattagcttgcaccacacaaatggaggagaaaaaaaggagtaatccattcctaaaaaattatcactcttccaaaccttctgctagcaatctatgaaactaaaaacattaagagttatcacgcctcctgcaaacccttgggagaatttagccatacgctttatctggcactcttatttgcctatcaaataaaggctctctatgccttaattcaacccagttccataattatattgagccatctctaccatcctcactaatctctgaaaatgtaaataactgtcaaaaataatgaattattagcaaaaacaagtaatattttatgagactgaatgagcttttcaagatcacccccaaagtcaccagttctatgctctaaaactgaatcacaacaagaaaagcagtttagaatctcagctttcaaatctcaaaattacaaatattattaggccccagtcccataaatgagtcatcaactgaaaggaaaaaagtcatggaaaaaaaaaatcagcaaataaaaacgagctttatatttattcctgattcaacaaatccctgtctcgagaaacttaatgaagcacttgacatttaagacatacataaaaatgaaactagatatacagaataatctattattattttctaaagttaatggtatgaactagtgttacagtagtctccataagtggctattaacataggtcagttaacacagtagtttcatgatttagaaagtttcacttgaaagcaaggctacagtgaacataggccatttaacttgttacattgtggaagattcagagatgatacacaaaactttacaagttgaaatgagttctgtattctcaacatttaagttcagctaacatttcctgagcaactacaatgagctgggcactgcaaaagatgctttacaatatgcattatataatcctcacaataacctcatgatatgggtattatgtcccccattttatagaggaaagaaactacgctgtaaaagccagggtcacacacttgtagggtggactccacaacatccctcacttcgcgtgtatattacacagcatggtgttagtatttacagctcaaatacttacagaagtgaatagaggtacgaaatgatgaaagatggttttaataaaaaatggcaagtttttaaagcctttaatatacattgtggaatgagggtgaactgctgtggggcagtggtaaggtggcagaagatgagaggaaaattattttaaatcaatgcagagcactttaaataaaacataataggatttcttttaatcagagaagcagcatggcatagcacaaagagcaatggctttagactcggatctgtattccattcagaggggctgcttcttttagctgaaattcaccgaagaatgtaactttcttatatataaatgtatacaatatctgccttgattctttcacataaatgtttctgggagcaaataaagtaacataagcaaacatttgactagtaaaaaatacatcaataatatgttgttttattattatctaattaatgagtttcatattttgtccagatttgacctaagtatacttttattaataaatgcatcagagtagtctgctaaagtgagattcaaaaatggacagtctgatgttgaaactgccttaaaacattattctaagttggatgaaatatttcattacatgtattggttctttgaattaaaaaaaagaaaaaaaggcaatataaatttaaataggcagcagttaagctgaggctcaggcccaggtctttgatgttacttcactctcaccactgcacaaattagagagtctaaattaattcttaaccttttttgccaaagaccccattgacagtcaaagaagtggaccctttctcaaaatagtatttttaaatgcataaacaaaaatacataggatttcaaaggaagtaaattatacttgaatgcagctatcaaaatgcattaaacagcagtttatgaaatagtaatacacatgtgaggaagcaatgtagatgtgctgctcagatctccatttaggaagaactttccattcagccgcaaggagtgcatttagctgacaggcttcaagttgttagcacctttagaatcctccttagcttttgagtccaggccacactcctcctgggcagcccccagccaatggctgagcctggcacaagtagtaaggactgccattaggacccaacgagggactcccctcacaggcatcatttgttccagagctccttcctggctagactggctgagaatttatcaggtttacaccatggtctaaggtttttcccgcccggtcttgcatcctgacccttaaaaaaaaacacatttacactccagcatctctgtgtctgcttccaggtggaagcaatcaacaaaatctgcttctttattaatgaattaaataacaagatctagttgcaagtctaataactaccttaattttgaaatactgatcattttaaatgatatttcaacttaactaaaataattctaatgtattttgaaagtatatgtgaattgtactcatggaaacttaataggtactgctatgtttgttacctataattgaagaaaaagctaaatttcaattagaggttaaagtatgtgggttttttttcctattcaagttcagaccccagaattctatttgcagaccccaagttaagaatcctgggataaagtgtctgattttgaaacatccattcttttaagatacagagatgcacttagacaagtgaaagctgtggttaacaaaaggtctctaacctggcttacctactcagatgccaacgcacatgtgaaagcttctattaaatgcacagaatacattataagatcatatgcccaaatgatttaaccttgagggacaagaacagcttatctaaacacatgaatgcataatcacctaaaaatctaaactgtgaaattcaagattctaaaatatataataaagttatttttatacagatttttctaagaatatactatactgtttaacatcaaaatgctacatagaatttactacttactatattataccatttatttgctatactatttatttaataccaaattgctatatagcatttaatctagcaagaagtcctctgtatctacttctgactctcctatcttgaccctattctcttcctgtgttccaaggatggtatcaggttaccattctaactctaggtgattccatctcttctagccaggcaaacagtgtatgtaatgggggggaggggaagggggagaacaggtaaatgaatagctagatttacaaatttttcttcttaaatagagacagggtctcactctatcacccaatctctacttttgtagagacaggtctcaatacattgcccaggctggtcatgaactcctggcctcaagcaatcctcctgtcttggcctcccaaagcactgagattagaggcatgagccattgtgcccagcctcaaaatattattaatgccctaagattacaatagtgcattcagaaggataagcctcatttaaatttccaggtgaataataacaagcactaatttgagccagagtcttgaatgacagaacatgatgcagacaaggcaaagaactgcctaaaatagggaagtgaactttaagcaatcggagggcaactggaattgccctggtgaaatggagagtaaggcagaagacagagaaaatggaagataaattctgagacaaaaggtgtgagataacaacaatgaaatgtaacaactttataattttgttaagggatgatagctacggacacaccactaagaacttactaccaagattaaaatatcaaggtcaacttgtaatatggaaaagcaacagtatcctccaatctaccattcgtcaagtgactccagtcaaatccattaccctagtatctttcctttctccagtagaagtaggaaaggagaaaaaagaaggaaaaagctatgtgtatgtacatacacacaccaatacacatacaccctagtttcctctctttctgtttgtaacatctgtacagtatgcaagaaacatgtctatttatagggattcaaaacagacatgttttttgtatactgtacagatgttacaatgcataaatttctaccacactataccaaagatatgctgtaactaagcatttaaccaaagcattaggtggacttgcaagtcttccttggctccaagctaaataaatccactttctttagcctctgtctttagttcccatttcgctaaagctttcaaaataaatttccatttcttccgcaccccaacagagaatatactataactggtaacaataagatcctttaatgggaagataagatattcttgacccatttcataatttctttaagtctttactacttttgagattcagccacagacaagaaccaaatgatatgtccctagagaaatatttcattctctactgactttctccccaatctttccaaatcagtatttgtgaaatattctgttcttttcaggaaactttactatctataaaacatgttgcatttattttggcatcatctctttattagcatgcattacaaaaaaacatatttctatgtgttcaccttaatgtagccttgtgaggtagtttaaaaaattttatacacatttgtttgtatagaggaataaattatgtttcaaacacaatgcaacatcttgaacaccgccaagttgctgggataatccacgtttatcacctacttcctcaattctttgtccactgaactatgatgtcagaaatctaagcttgatttgtttttaagtggataatccattaactgtttccatatgccataactattcagttgagaaataatttataaaccaatttatgggccctatctggcaaaaatgacacacctgttataaaatatgattacttcagaaagctaacaattgtggaaccacattttcataataaattagtctaagtgaattagactattcatatactttcagaaagccctttaatccctattaacagtttgtgaataatgaaagtagttaatattaattttacttgacaaatccaacaccaataacctgttagtatactctaatccattttccaacagcctgtaaaaattaaccaacagatgcttccaatctggtaaaaaaaaaaaaaaaaatacataggtcattagcattattttgatgataccaaatgttcaatatatgaatattatgattaaatttcagagagatagataaacaatctttttttataaccttgttaagtcttaacagaagctgaatttagtaaaatgtcagtcttttctaaaatcaaaatcagcatttgttattccactccttgttattatgcttcaactaagtacttgactgagtttcatcaggaatgtaaaagcaacatgagtatgggaagcacacctgccttattcatgctggtatccccaatgtcaagcatgaggcacaacatgcaatatgcacccaataaatagttattgagtggaacagtggtagccaataagaaaaagtggaaggtatgaaagaggaggtatgagaaaaagaaaaaacataatctggaaaagtgcttatatacatttccagaataatttaaaatacagaaagctaagatgtctcccaaaaacttacaacagagagaatcaagaaaactgaagtgagctacttaacagcaaaataaagtgtaaaagaaaatgatgtaagtgaatcaggaaaaaattactgatttttcacaggaaaaggattagagaggattcctattcctctacagatatggcacaaggtactttcccacagaagcgttgttgtaaatggtcacaaagattagtttaaaaagcagaataggtaagatctaattggaaaaaaaaaagtaggaatgtaataaaaggcaacaggaattaagaggaaagagccaagcccttaccaagaatatcttggtaatatgtaaatgtaggtagggttggatagtatcacaagaagccagaattgttttgccatcaggagaccaggagaaaagatctcagctgagatacactaaagattaaacaagataatatgaagagaacccagctgaggcactgatatatcacgtatgcacaatatctgatatagatattagctccttttccaactctaagtgtattagacctgtaaatcccagtagtctaaacattagaagtcctgaaaacctaaagtagtgtctaccataagaaaaaagccccacttacttgacaacaaataaagtctacatgacagaaaacttcaaggatctctttaaatgattggattcagttcctttgttcttactacccaatttgaatgcttgggaagcacaaaggattggcatctatcatttaaatgcctgggatggaatgtccatctttgtaatcaaagaaatagcctcggttctcagtccaaacagttactactgcaatgaaaaacagagatacaccatttctctaaaaaacccactattcttcagtaattaccatccttccctacctagttgtgatgaaaatcagccagcagccaatgcctctacctcctgcactggcttgcgaaagggtggaaagacaaatggattttcaccttggagtgaacaatacataagtgaccaggtttacttttgtttgggggtttgcctgtttttgtttttttgtttttttgtgtttttttgagacatagtcttactctgttgcccagactggagtgcagtggcgtgatcctggctcgctgcaacctctgcctcccaggttcaagcgattctcatgcctcagcctccggagtagctgggactacaggtgtgcaccaccatgcctggctatttttttttttaattttttttagtagaaatgagggtctcatcatgttggccaggctggtctcaaactcctggcctcaagtgatcaacccacctcgacctcccaaaatgctgagattacaggcgggagccattgcacccggccatagttttgaattctgcagcaattacaaaattgattcaaacaaagtatgttggactcagggagatacgtgaatgtaacatttggacccaatgcctcagcagccaggccatgaataaaagaccacaagtagacctgtctacttgaccagtcctgtctaagctctctggacatctttctctttccttcctttctgatctttcctattaaatgtctatataaaatcctgtttctctgaacgtagcaatgactggcctttcctataaaatactctgaagtgttttacatgtaaatacacattttaattgtcatatattctccttgattgccagatgaccagtaatgccaaaaagcactcttaggactcctcaaataatgctttctaggaattattctttaaaatgaagtcccaaaaaaatagtcacctttacagctcatctctgcttaccactgagaaatgttagcagggctcggagtcacaaccctgggcttccccactctttgtgttccccctggaaatgtcatctactgtcacagaaaaaaaagaaagcagcatttgagttgaattgagacagaaggtatcatagtcctctgccagcctctaagtcaagtaaagagattccaggccaaaggaccagcagtacaaaggcagagagagatggaaatatggagtatgcaaaaaatgatcaccttttcaccttaatctttctaactagtattagatagagcaaatacatcatttttttattcaaccttgaatctcaaggctaaagttagatgacttaagaattttttaaaggtccaattatttcatttagggctaacattgcagctaaattaaagacatgctaacaagtttcccttttgagcctcattaattaagaaagtaatcagagtaaggagaaaaagagagtagctgtatggcagaattacttaaatagtttttaggtaccaccatttgtacctactaggaaagcaaaaggaaaactaatcaactccagattatgaaatctgaaattctgaagtgttttacatgtaaacacaaattttaactgccatgtattttccttgattgccagaagagtacactaatcttatttgaagaaaattttgatcctccataatcaaaaggtaaaattaaaatcttattcacaaatttactagggtgagcttgctgagaaaattctccctgtgttcaaagaccaaaaatataccatttttaatactttagtcaggataaatggtactcaaaaatatctgttaactgtttttatcaaattctagaaaactaccttaatttacaattaccttttggagagagtttctaatttacattaataatttcttaatttacaattaccttttagaaagagattctaatctttcagaaactcattcaaaggaatactaatacatttttaaaatatctgccagcattctttggctgctgtgctcaagttaaacagatacataaagcatctagcatggtgcctggctaacagtcaacatttaggaagtcaactcaaccctctacacaaaggtctctgacctgtatccatccagtacaatctctccctgccacctcttcctttgttctatgagcccagggatataggtggcataagtctatagtgaaaaatttctttttgaaaattaaaaggtaatgattgatctaagtgttttgcactacagacctaaaatgtaagttttatataatacttaaaaattctgtgtggatatcagccttgaaatgtaagtagcaggcccacgaaattggatgaaataagttcaattttcacttatgtaatacctaaacaattttttaaaaatcacactgcacaggtaaaacctatcacaaaacattttggaaaatgaatgccattgcttttaatgaaaagatcatataacctactcagatacttctctttcaagctaactttgaagacattataaatctgatatttttatcccatgtgactcatagcaattaattaaattatgtgatagtcactgtaattttttttggattatactttaagttctgggatacatgtgcagaacatgcaggtttgttacataggtatacacatgccatggtggtttgctgcacccatcaacccgtcatctacgttgggtatttctcctaatgctatatgctatccctctcctagctcccctagtcactgtaatattaaagggtagtaaaattctaactacaagaaagcacacattttgtttttctatttttcaaactgaaggaccttctcatgccaaaactgtcacagaaaatatcctcttttacaaaagtctaatttatcccaatggaatatcttcaaaaataatatcatatagaaaatttaataatcaaaattttatattaaccttttgcatttttaaaacagaatttactttttaagcactttatttcattataccatttatttgcccattaggaatgtaaaaataacatgtacaggattcataaaataatgttttctgaaaattgatacataaaaagtatatgttaaaattctaaaatcaaattaataaataatcaagatgttaaacttacctttttgttggcaacaaaatgtattctcaagtttacaaagcaaatccacgttttcatacttattttcatttacttttatccagaaacagttttcagtcatttcatgaggtctgatctacaatcagagagaagactgattcatcaataggtgagtgtttcacctgtcccaagtcaagcactatgcatacactgagtatcatagctgtcagcagatatttataaagtcgtatctgtaagatttttccctgaagtgtgttcaataagatacaagttctgcaggatgttaaggtcttattaggaagaaaaggcttccatgatccaatagttgaggatttgaaatacgatttaattagcttcttctcaattgcatttctcatagtctctaataatcttcacctgcactatacattttggtgggcaggacacattatacagcattttccatgtttctgttaccatgaaaccatttttctgcaggattctgaattcttaagatctgactagatattagcttctgacaactagttaacactttcccaacatctatcaatagagaaaatttcctaagaacaccatcatttttttttgagaaacacttcataaacataggattcactgcaataatgtttaattatcaatttaattacaaatcggattccactggaacaacatcaactctcactgtatttataaagcagaaagtcttagtcaatatgaaagggatttgtcccaatactttaaaaaaaaagctattttattgtcactttgattagtgacattagaaattatgtatatataaattaaattatgtaggcataaattaaatctcattagaaattatgtatatataaatccaaaattagatttagatctaagtaaaagtattttcctctattaatttcttttacctttaaccaattcaatcttctcatgctgatttcaggtttaaattctttctttggtttcaacccaaatggcaggattggtagaggaggagaattttgtcctccaaggaatcccaggggaggtggtggaggcacaggaccactgaatggcatccgcattcctggaagtggaggaggtggtgggggaggaggtggaggcggcacccctccaccagaaggcagtggaggcggaggaggaagtgctgagtggccagttccaccttctttagagggaggcaaaggaatattacaatcagctggcaaggcaccaaactggagaaaaaaacaataagagacataactaagaacatatctacaaaacatgtaaatatgcactttactcaaaaataaggcattcatttaaaccaaaaataattacatatcagtaatttcataaggtttaaccaaaaatcaaaattccaacaatttttcttctaatttaagaatataattatagctttttttccctcataaaaacataattgccagaagtataattccctgttttgaggtagttatgaccatctaggtagaaatgtccaggagggaaatgggtatgtggatctagaagatttgaaaatcagtagtctctggagaacagttgaagccagggaagcagagaagttcactcatagtatggagagaatatgtagcatgacaaagggtctatgcacagagttctatggagtgcaagcatttaagtgataagtaagaaataagatttcaacaaaagaacttaaatggtattgccacatcatgactttgctcaaatcttctcaatggtgtcctaatgcacttgagaaaacaacaacaacaacaaactaaaattcttcgtaggacctatataagtatatcatgatctagtccctgctatctggtcttgtaggggactttcttctaattctgtgtatgtgccaacctcatgctaatttcagggcccttgtacatgctggtccctctgcctggaacattctcttcacctgaccatctcctactagcctcttcagtctgagctaacaggtcccttccttgggaaagccttatctgaccactcattttacactgatagcaccttgtacttttcaatagctcttatcaaaagtgagaatttatttaaggaatcattagcatttatctctttgacagatcataagctgatgaggtaagtgactatcttgtattatttactgctctttccccagcacctaaagcagtgactggtgcatgacagctatggaagaaatgcgtaggataaatgcatgaaagacaagaagagaaaaagccaactgggcacagggtcaaaaactatgaatgaagagagcaccacctaaaagactgctttgcagaatcaaatgccacagagaagcaaggtaaaatcaggggtgaaaaaagaaccgcctgtgtccactggtcacttttgtcctcatgtttccatggcataataagaatttaacagatgcatttcgatggatacaaagaagacattctgggttaataaataacttttgtaatatgagtagcttcttgaaattacaaacttcaattctaactacctttaacatttaataaatgttacataattttgaattttcatggcacaattatgaaaaatagaccatgtataaaagctcgaaatcaatgacgtctgaaatcatgacaaagaaaacagtgttataaaagaagttgaggccacaaatcaaaagcatgccttatcaaaaccattaagtataaagaagaaccagttcagtgttactctgggttgctgtgatcaaagatgatacttccttttgaacgtatttaataattaactatcaatgtcttaaagatatggctgaatttctgctctagaatagttcatttgataaagtgtgaagactgacttaaagatatggtttgggaggccagacactgtgactatcttgctcatcactatgtctctccagcacctaaactacctggttgtgaagagactacgggagcaaaggaattaaatcacagataacagaacatattttattcatactcttcatagtcagcatagctttgaacaaaaagaaggatcttaagataaatgcccacatttcataagaaataaaccagaatccaaagaaagaatttgccagttgttcaaacatgaatatggtggccaatattaagtatctaattctaggttttcttctcatagccataaacatgggtcatcactgtatacaatttaaaacaatttaggagattccttgatttaatttcactttcaaaacatacacttattcccattttatgtaaaagcactatgcagcaataacttattcaaaaatggtggatacgttttttataaactggaattttctggagatttacaaacaaaccttcaactgaacataattaaaaagaaaagaaagttcttaaatttacgttaccccagaccaagaaaaacttgttataaatatttcagccactgtctgtaactcagtctgaagtacagacacaatcaaatgtttctttcaatatgagagacaaggaaccatatgggaaagataaaaaaaaaaattcaataaaatgtgatacttccctcttgcagcactaaagaaagaagatgaatgagaataattttcttgtagataggagattttaatttttttctaaaattgaatactaacagatagctatctcttaaggtatctccagacagcctcagcaacaaaactatccactaagcatttaaaagaaaacaaaattgccagtaagataggatatagtatacctgagactatttcaacataactgtaaattaagatgaaaggaaaatagcaaaactatacttattgctcatcatcctgtacgtaaatctacatgaagaaatttagctatgaatattctacctccttacttacatccacataaagcatgcagatgacgtatttcttgctatctaaatgttttatgtgtagagggtgcatgggagctatctgcttcataatccagatttactctcttttttgtcatgttttaaatctgtttactttggaaattgaaaaattatcagaaaatgttctcattcagctagaggttatcttttactgcaagggacccctaggctgaaggttttaaaaaataaatagcttgagcaataatttcttgtagtgggataaagatcagtgatgaataacaaatctgagagtaaaagattttcttactctttatgctgaattacttaggaaacatgtgacattaggaacaaaaccctaacaaaacataagaaagcagattaattagtaaaagcttagatatacatacatatagaaaaaaatgacaaaaaaatagcaaaacacagtacaaataatgctataaaaatatacaagcaaaattaaagtttaaacattttgatgctatgaagatataacataacctttgctccctcactgtgtttttaatacccaaattcactcagagtggaattttacctgagacttaaaagcttgtagctctgcttgaagctcattaatctttgcctcttttttctgcaattcagcctgagtttcttggtggtcggtaaactctttttcaaactgaaacaaattaaaaataataacaaaaacaggaagatgaaaatgaaaagcactattcttcttatagaaatgtgactcgaatgatctgccggtagaacacaaattcctgaattggttttatgaaaggagtgatagagttttgaaaagtcacttacagtctttctctaggcccctccaggtcccaaccaaaatcgttcattcacaagggggcagaaaaaagccatagacaagtctgtgaccttctctctgcagagcaaactggccacagttatctgcagcattggcatttttcttcaaagtctctaaatattattgtgactttgtgtaaaataatagagagcaaagcattgtacaaattccttgcatcttccacctgcaaaaacttattcttgaaacttatctgaagtatatcaacatgatttagaggatttcattttaatattttttattactaaacaactccattctattcagtttctaactttttttcttgtaacaacataatatctcctgatatctttgggaaagtaatgataaattaatttttcaaagtccctagtgaaataccttctggaaaaaaaaggaaacaataaaatttggtgaatccagtgaattttctataataatttatatatccactcatcaccagttctcatcttgcattcaaacacattcaactttgccattattatgactaaaaacctcctttttgctcacaaacacaagcatttgactttcttaagaaaaatgaaaaaaaaaatcaatcaaaaaaatgcaactatctcacaaatgtggcctccacattttaaatacactcaaaccttaattaggaaaataacaacaatgtagaactccaccgtttacaaagggattttatttttacttagtttataaagggaatcttactttgtccttaataacactaagaggcagttgctagtccctcatagctagtaaaagatgtgagattaaaaagccagattccccgccttcagagtctaagttcaaatgaaactatgccacctccctgcaattaacgtttagataatgctttacggttttacttaacagactattttttggagcagttttaggttcacggcaaaactgagcagaaaatagagattttccacatacccccaaccctacacatgcattctctctccccatactttatagcttttgaagcataaaaagaagcattcttaaatttcattacaaaaactctgtgaaataagaaatactgctttaattcccattttacagggaaggaaggtaaatttcagactactgattctctcagtctcaacctgtgttcctttattaaaataacaaaaactaataggtaaaaactgtccaaatgtccttcagttgacgtaagccacagcaacactaccattccccacaactactacggctcctacaaacccctcttaccgttaaataattaaaaagattctaagcctatatctaatcaaattactaactacaaaacaagccatgcatgagtctcagaggtccgcccaccttctcctgtcacccagtgcttccccctaaggacttgctaaatcaattgccttcacacctcccttgcatagtttacctctctgtactttcatccctcattttactccttataaccccttaccataatccctctttagcttaaaagtcaactttttcaaagggtattcttaaaccacactcacttttctgacctgttgaactctgttcatttcattatctatcacacttagctataattcattctaaaaacgctgacttaccaaattccaattccagaagtccaaattccctggactgctctcagcctcatcttaggtgatctctctagggccatgctatttcaatatcatagccactgaccacaaatgattatgtaaatgtaaacttaaattatcaaaaataaataaagtttaaaaattcagttcctcggtcacaccagccattttaaaaagtacactatgggcacatatggctgatgactaccatgcagaacaatatagattataaaacatttccaccatcccatattagacaggccagttctatagcataaatacctacaaataggcctccatattcaacctcttttcctgtatgttccattacaacacacacttctggttctcctgctactccttgagtgctcctaccaattcctgttatgggtttctacaaaatccaacccactaatgatggcattctataggactctttcctcaccctcctcctgcttgtctcatcttccacagccatgtttaaatcaccatgcatacactgatggcttacaaatccctatcaacatctcagcttctcatctgaattccagactacaaatcagtccatgaatatatttccaaccacttaatgaaaacttttcaagacagacgaaaaaacatattttcaaaaccaaacatgtttccccctacaagatttgttttttgaatgttgctattctttgtaaagggcagctcaactaacatgacttctttgttcttaaactatcagtgacttcattataatcattactatctaagaaccctgtaggatctggccctaatctacctatttcccattacgcaataaatatttaacaacacacccgagatatgccccctcagagtggtaggttctgaagacacagttaaacagaatatggtcagtgtacttttagtcagcacagtggctgatggagaagtaaaagcaaactaacaaccctaaatcaattaaaaataccagcaataaagagagagacagagagagactgaaagctggggaatgattcctggaggaatgatgtttgacctcaaagtctgaaaaacttactagcatttcagcgtgtggatgaatgacaagcaatactttgtaaggggcacaaaaagaggtatgagaacaaactgaaggggataaagccagagatgaacacagaaataaaactgctgaaaggaattttgcaataagccaaagagttaatcctcttttcctaaaaatcctggagcattattaggtatgtataataagtaaacaacataatcaaatttttactttcaaaaactcaaccagcagcagtgtgaaagatgggctgaaaaagacatactagaggcatggaaattggtttggaggctattgtagttatccaagcgagaactgaaggccttcctgaattgaggtggaggagagggtaatgacaaagaaatgaaaaaagactacagaatccaaaaatgttagtatctgaccgaatgaaggaaatgagcgagaggagtgtatctaagatgactacagggttttgttgttttacaagctagaaaaaaagtgttgttatttggggaaaataaataaggttataaaatgcagggggaaaagatatttttagggagaagaaagataaatttggtttggatatgctcagcttgagataggtataggaaattcaaaagaaatttagatatgcatccttcttggctatctcgcgttgttcttcatactgattcctcaaggctcagattagacatcacttccttggagaaggcttccctggccacccatgactaggtgagggacctttcctctaggtttacataccacatagggtttgtctaccataccaattgcacactgtaatataaaattgtcaaaataacactcaccaacctgaaagctcataaatgtgagaaacttttctattttattcatcacctttccagtgtcttacatctataattaaagtcaaataaatatttgttgaacgaagtgatgagccaacctcgtcaaatcttcctttatatgttgaatgactatgtcaacatagtcactctcccagcatcagaaatctttgagaggtcattttctctttttgacaactaagacaaagttcactgttacacagcaagaaaaaaaattacgttcttatgagagtaagaatgaaaaagcctttctacaatatcaatatgtgaattatgaaatatctatttcataaatcctagactaaaattcataaggaaaaagaattatttcgggacttaagataaaaattataaaaacaaccacagtcataatgagtacattctaagaacatttattaaattaacttgctaatactaaagtaactgtattacttatgaaaaaataagtttccacatcctcgcctataaaaagatagctgaaatataaactttgttttagcatttttgtaatatctatagtcaaatcactgtagccttggggaaaaaatgaatctccattaaaagcacaccttataaaaactgatatgatagccttctccaaaaagagttactagagcgatattacacttacaaaattacatgcaaaaaaatgttgaaagacacagttaaggttgaggctctgcttaatttcattctctagggtgaatgtattagtgcatctgtacaagaaggttgataattcaatattctctatatactttctgacatttctggtcttcatttttcaaatttatgcaccaaaataaagaatgtgtctagcaaccatgatagcttcctgcctaaagcaaagtatttacatgtgtccttataaaactatcagaacaaagtttttgctgatatatacaaaatgatatggcaatagaaatattttatggagcaaatagtattttctgaatctaactaacacatataatttctgactaaaaggagacaagtaaccttgaacaaggtctttcttctatttatatatttaaaacctacaatttgtttaaaaatctgttgagaaactttaactccattcatgtttgactccattcatatatactatatacctaaaaatgataacaaaatcaaatttatactatctgggatgtatccaaatcaagtacttgaaagtctactactactttcctatgaagagttaaagtgcttatccagcttagaatacaatgttggctgggggaagggtcaccccacaacatgaacatctatccactgtaacactatgagactaaatttaaatgatccattaatttgtttcccccactaaactaagtcacttcagagcaacaacaatattatattcacaactgtaatcctaacctgcagccgaaggcgtgggaaataacaacctctcatttagcgtttggtaaagtcagaaccttaaggccccttaggacatttataatgttttacctaagttactcttaacttacaaaacagtgcctataatttgtaagttatgttttatcttcaaagctatagaaatgtgcaactgcctcaagatacatttagtatctgctacatcaaaaacctatactccttggcatgatgcctaacacacaggaaatattcacttcgtaaatgtttgctgtgggttcatcatggtgacaacagtagtaagaattatcgtcactccttcaatgtgaaaaaccacctgaataattcaaatcagattgactatttaaaatgcaaagaattggaataacaaattaaaagtctaataggtacttgctaagccagagataaaaggacaaaacaataccttaaatttatgcctactgttccattattggaacgctgagcatgtggaagttatttatatcctactgcttaaggtcactgccaatgtctgatttttcaaaactcaaaaaaattgcaatctcaggcataaatgggttaaagaaaagtaaggaattggctggatggttagaaatactactgagttgaaacaaaactggttttgtttgtgtaatatccaacagctatgacctatgaaaatggcaattttataaagttcaacttaatataatgaagcaactttaatcaaaactaaaagcaagttaacttttctcttaaaatttttatatatgatttcattcttaagggcttaatatcatttcttgagaattaccacaaccttaaaattttgattacatacattttgctccatcatccactcattcaaaaaggatctttttagttcttacaaagggccaggaattgttcctggtgcagggatagtgaataaaacaaacaaaatgcctcaaagtttactgttagggtgaaatagataagtcattcacatataaatacataaactatgtagcatgtgagatgatgataaatacattcaaagaaaaataaggaaagaagaatagggaaggtcaaggttgggagtggggagttaagactttttagatacagtagtcctccttggtggagggcatctatgcacacacctgaagcagataaagaagaaagaacgaataacaagcaaattccctgaggcagaagcatgcctgcagtggttccccacagaatactataaagttagtgaaaactacttactttcttgtaaagttctgatgctttctcttcaaactcttctagttttgcttgatctatgcaaatgtctaaaattgcaatgacaggaaatttttaatgtgaaacttcttaaactcattatgacttcaaaagtttagaaagaaaaaagatcatagaaaataattaaatactgatactaccagtaataaacaaaatggaaaaaatattataatgttggaatgaaaaaggcttttctaagcatgataccagaaaacagaaaacacaggaaaagccaaactcaataacaattttaaacttctagcaggcaaaaggagatgttcaattgtaataacactcaaatgtttctatcaccaactcgtacatattttaaagaaaaaagatgatgtctataaacaagcttaaaaaaaacagccaacagtaataaacagaaaattagaaaaattgatactaaaaaatcaccaaaacagatgaataaatgtttattattccctaacaatatgaaaattagcaatatgaatgtgaagattaaatgactgataatgccaagtgttggagttgacatgaggaaaccaatagtgaaagctaagaactttgctgatgaaaaactaggcaatatatactaaaattgtaaatatggattttcttttaacctagcaattccatttctgagacttggccattaggcctgaaaactcattaaaatattttttgatgttagacaaaaaaaaaaaaaactgaaaataacttaaatgcccatcaataatgaactgcttaaataagttatgatatatatacatgatagaatacaatgtagaagtaattcatatggatttcccatatgttatcccttcttttttattaaatgaaagcgatacatgaacaaagtttataaaaatatattacagaagaatttataataaaaaataagtcaacaaagttactgtatccaaatcttaatcacacttcctaaatgcaacctcttattaccatttctatactagattattttggtggttagtttcttaactgtaaataaaatgtacataagtattatttcttgatttatctatttaagacattatagataactttctattataaaagattaagacagtatttgttctctaatcctaatttttgatattttatttactaaactggattgctccagagcatgaaatatttaattttgattcccattacattaagaataacttaaaattcttgccacagtatgtcaaattatctgtgcctcatgctttccaataccttttctcccctattgcccacctttggttcttctctcacctattcatagaaatacaatgacattctcttctgtatttaaatcttttgtatttacttatgagattattctaaatatttaaaaatcagtaaatacaattaatttattaaaactacataagcacgcatcacttatacaaccaaatggtgttcaaatattttatttccttctcaagagctcagtgaaaaaaacctctcagctgccattcctaaatgacccagtggaatacattttttcagatactattcaaaatcattccacattttagtttgctgcatatttacagcaccattttcttaatttctgcttcctcttcccactccccccaccccaggaacttctaattgcttatctcttatagagagaaacaagcattttcattaatattatctagttcttcactaattatatttcattcttctcccaggactcagataatatacgaaaagaaacataaccctgcacagatacatagctgaaaatgagaggtgtattttaatagccttttcaaatcattgtgggtaatcttctttgatgttatatcgaaatctgacaaatggtgacttcttaaacagtagttacaatgtggaatcacatatcatatcaattaacttgtactctgttaccctaaaatctcttgataaatgttgcacttttaatagatcttttgcctatgcagaatttgtaatatcaggcactggtcatatggaaagaatggtgtgctgagtcatgcaaatgttccgaacgttaacaggtctttatacaatatcacaatgaataatcagataggttaataacaccagtgacatcaggaaataattttagtattgagaacctgtcagcctaaaagcagcagatacaagttttccaaaattcaaatttccacttaaaaactcaaattttctcattggcagcctatttatcggccattttctttgaagttataggctcactttatttcatttttaagaaagcaagtgcctgacgaaaactttaataaaaactcaaatgttacaacactaaataataatgctttatctttaaaaaaaaaaaaaaaaaaaactctcaagttatagaagccatcgtctgtatgagtcattccaagtttaaaaaaaaaaaaaaaaaggcttcgggggggacaggcaattctgcttgcaactcaattacacaaatattttcttattgaactcttttaatagatctttgcctatggagaatttgtaacatcaggcactggtcatatgcagcagaagtactgtatgtataaatcccatttgttaacacagaatattaaaacagtgtgtatacaagggtcaggctttaataaagttaacatttttaggaccttatcaaaggcattcttaagtaaaaaatggcagtttttgttgttttattgacagtaaagatgataatgactactcccacagtttagtgccactgccttgattcataacaaagtgccaggagttttactcaccattgttctgcaccaccagtgcaaaataccaacccaataaaaaaggcgaataatgtttttgtgctattatgaaaacagttttgacaattagggccctcaggagtccagagacacaacccgagaaccaatgccctagagctcattcatagaataagagacaataagatatttctatttaaataataaatactcacctacaaactgggttaaatctaaatctagtctttttcgatatgtgaagtctggatccattccatctctatgcaatacaatctgggatacacactcatcaattaatttgaagtattgttgcctaaaaccaaagaaaagagtaaatgtacaattgataattagtgtaactttacatcaaaacaaaactttttggctaagattgatttcaagttcaacaatttattagtaatataatttcaatagttgacacaacagattttacctgggagtgagagtaaatacaattgtcatcactttgcttttaatgaattcaaaacatcatttttatagtcttttaggaaatacagtatcccttaattttcttataaaagtcaaaaccttgaattaagtaaattagctgaaagtgaagtgataagtgcttaaaatttgtgctcagaggtcatcaactttccactgtaccacactgaaatagctatcattaattcacttcattaatacaaccaaaataaacaaaaattttctctaaaaagttttatgggagtatgtggtatactgttttccaagtgtttgtgaaatcaaatttaaaactggtactgtaagttatatataatatcaaattcatatttcttactcaaagggaaatagaaaaattcagtataataatatttgtccaaaaatcgaagtttaactaaaacctccaagtagatttcatgttgtcattacagttaagtctagtccatctacactggtcataggtgaaacatcccttaagattttgaaaggatcaacaaaattgatagatcgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggctcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtattggaagttctggccagggcaatcaggcaggagaaggaaataaagggtattcaattaggaaaagaggaagtcaaattgtccctgtgtgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaaaagaataaaatacctaggaatccaacttacaagggatgtgaaggacctcttcaaggagaactacaaaccactgctcaaggaaataaaagaggatacaaacaactggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaatggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgttggagaggatgtggagaaataggaacacttttacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacgtgtatgtttattgcggcattattcacgatagcaaagacttggaaccaacccaaatgtccaacaatgatagactggattaagaaaatgtggcacatatacaccatggaatactatgcagccataaaaaatgatgagttcaagtcctttgtagggacatggatgaaattggaaatcatcattctcagtaaactatcgcaagaacgaaaaaccaaacaccgcatattctcactcataggtgggaactgaacaatgagatcacatggacacatgaaggggaatatcacactctggggactgtggtggggtggggggagtggggagggatagcatttggagatatacctaaggctagatgacgagttagtgggtgcagcgcaccagcatggcacatgtatacatatgtaactaacctgcacaatgtgcacatgtaccctaaaacttaaagtataataaaaaaaaaaaaaagaaaaaaaaaaaagaccaaaccaaaaaaaaaaaaagttatttgagattagttgagcatgagtaggtatttattgctttctttttggccagaaacttgttagtgaaataaggctaatggtagaaatatttcctcttgtaaagcataatcatctcttcttgagaagactggttttaaaatatcctagtgcttttagatattgtacctttttggttatgccaaatattagttcactttggaaagccggtaatatgaaaaatgatgtcactcatcattagtacagaggattaaagagaaaactggaacaagaaagatgtctcagaaagggacaaaaaaaaaaagatttaataaatgtaaataaaacagataaaagattttataagcaaaaccaaactaaagtgataaacaggttgggtactattctaatgaagcacagtcctccatctcagatcatcccctagaacttctttccttaatgacttttaacatacttttcctctctaaattctaaagtgtgggtccctcaagccatttagactttcctttccataaactatgacccactgctcttgacctacttaccttacacctaataaaccatctattacagtgaagaaaatccactacagcttaacactagcaaagatgactaatgatcattaactgtcatagagtgaaaatgtttaagaaacggttcctgggtacaaatcaaaagtgttaatctatgcttgcctctatttgttcaagttctttcaagacattatctcccatccccaaatatttctgccataataaccacatttacacgtggtacatacatttaaacacatttacatctattacatttaaaaatctagatgatgtatttcttttctactcaacattattctaatgtttttaaaatgaaaatgttttaaattaacaacacaagctatttcatgtcatctttttaagaaatcataattttagtaagtttttcctcaactccacaatgtccaattatgagttcatctataatgtggctgaaatttcatgcaaaaactcactggggaggcaatactatcaaagaataatacacaacatttctggattccagaaatgtcaatctagaaaataatctccatgagcaatattggtgaggtagtaaatgtgtctgaggaatatgtgaataacttaattaagggatgaacattaagttgtcattactgacaaaatgctatttttgttggaggagtttttgaaatcttcacttttctctgtggtattgttaacaaatatcagaaattatctcccatgcgcatttaactagcgtggtattttacacatggtaagccttaattatttggtgtaaaactgaatttgatcttctccacccaattatcttgctgtatttcagccccctccctttttcccagggaaaaggggctgcctttgacatatattctccaatcgaattccatttctgtcaaactttcttttgtcccaaaagtggaaatgaaaaaagattctaatttttccatccaccaattctttcaaatgagaacatttaacattctgcaatagaacaatctactgtttgtaaaaagaaaaagaaaaattatgtgtgttcgtatcaaaagtagtttaaagagctcattaaacaaaaaatgttacaggttatctaagattgctgaaaaggtaaaatagaggtccttctgaggtagatgaaaccaaaaaatgaaggtaaaaaccaaaaaaacaacactcatagacgtgtacaccaacaagagtaagttttactgtatgtaaataaataaaattttaaaaaataaatgcatgacaaaaatatatgtaaattatcacaattctgacacaatcttggaataaaagcatattttaagaaatatttttaagaatttttttaagaaatttttttaaagaaatattaacaacaacaataataaataggagagtttggaaacatgaggaaaaaactgatggagttgtcttgagtctagcagtcacaggaagaacactgcctttgtggcaaccatatctggaatcaagatacccggggtttaaagagccaaagaaggaattaacataggtgaacatcaaatgtaaaagttcatactcaaaagatggccaaatatctaaatttctatgccttaatgtcattttggtaatgccacaatttaatctttctccaagactcttgatttaactcaaatgatagtatcacctgaacataacccaaaacagttgtgttttttaatctgttttgaagctagatacaaccacatgctctcttggggcacagatgaagggatcaaagtcataagtatgataaaacccctgcaggactacaggcatgttcaaaccattgaaaacaaacaacagtcttaaattcttgggtactcaaacagcatcaaacttccagaagacgacaggactgaccacacacagatcaaaaaatgtatggagtttactttagagtaaatagaagtttcaatgtcatttttaagtaaatttggagtagaaatatagtatcataaacagcatggtacaaatgatattttaaaaatctaaattagcaattcttaatctagcatttataatataaatatttaaactggtttatttttaataaaatatcagaaaggagcaaattaaaaaaatcagttactaaactcatattttagaatatcagtgggatttctggctacaaagagagtaattttgatgcatgtcctatcctcatcctgaaaaacctaaagttttaacattttgggtctcctccttgcttgttaggtacatcaaaaaatcactgagtcataccctctgatgttaccccgaggacacagcctgaatgaagcttgtctaaaaaactcttctacttgaaattaagtagaaaagaaaaaaacacccaaagtataagagaatgaaatttcagcaaacctaaattggtggcaacaaaatgattttatattcaaagagctcagcttccaccataaaacagtaatagaaatggaaagtagatatagagaacatttactaagcatacaccatatgccaagggtttggctagaacttttacccacattcccatatttcatctgcctaacaacccagtgagttaggcactaatctccatatttagtcacattataatgtagatgaggttaaaagaaagataaataatttgttaacctcagatggctaggatataatcaatctttaaaagccatttgtctggctttttgatatattagcaacattaaacgcaactgtattattaagacttgccagctacttaaacactaataaaagcaatgtttagtgcccttcatgtaacttataagaagaaacttatcaacatcattcctactgcctaagaaataactagaaaatattatctgtcacatgataaactagtaatttgttgctagtttgcatttttattcagatgaaaggttgtaaccaggaatccacaggagcttaaaaagtaatagtaatatcattttaccatcgtctacctaaatatatgcccagagaaaacaacacattctatgaatcagtgttatgacaaaaataaaaatcatttgcttgtcaaaggcaaatatgatgtgaatttcacaattaatagatttttattagtgaaagaaaacattagaatacaacttcctcttaccttataaaataatcatttcgaatcagcaaaagatgctgaagaatagaaataaaatatccctctgctctagtttctttaactgtgctccacaccatgttgtaaacatcatatgcttcagtgagttgattaaggaatatatggatttatttatactctacaccaaacaactataataatatgacagaatttgtcctgtaaggttttggaactgtaatacaggcatcttatatattcaacataaaatacagatatttaggattgagggtagtggaaaaactctggaaatggtgacttaacctgacacttcctgacttcccttctacaatcagttccaactaatctgtctcccctaagcacagatgctgttgggaacaaaggtagtagggaagctggctatgaatactgtgttgaattctaaaggttgcctgaccaacagagctggtggtcaggttaattatctaccatgaagaagccccaggtgaggataggaacctgttgggtctcatgaggagcacagacgtctgcagacccacagattaacatgcgacccatgagtatgcacccaagatgcagggaaagagcagccagtgactaaggctgccctattcctaatgctaaaaagccctaagtagaaggaaaagtgtcaaatataaaaagaaaacaaaatagattgcacacatacatataagaaaccaatctacagaatccatttgttagttgcagcatacgcttacatatatgtgtattcataaaaacacacaaattaataaaataataacattcttctgatgcatgaaggtttgatttcatgttgtttatatagaaatgagctaaatatttgtggctgagtattttggatttagcaataattttatatatgatttgactagacttcagaacaaaaggatattcaagttcagctctaatatcttcaaggcgatgggataactcaaacaaatcttcttctttatgctcatcaaagactttaagttggatatccaggccatcattcttaatgcattttaaattctagagatatgaaatagaaattatgatgaatgattttgtttttaattatgcaaaagaataaaaaacatataaacaataaaccaaccattcaacttgatttatagcattcgaacatttaaagtgttaaataacactcgaatcttatcatctatatttcaaaaatagattttttaactcaagccttttcccacagataaattattcttcaaggtaatttatctaaatttccccctactcaagtactcttttaatttaaatattaataaggagactgcagggcacttactggcaatatctctttcaatccacaacgcataaattcatttctgatgtgaagcctgaaatccaaatcatcaggagatgtaaccagggcattgatgagctgcatacaagctacctacaagagatcaaacagtgagacagactgggtttccaacattaaagaaagagtaacaaacgtaaacttcaaggttttgttccagcattattaaatatctttcctattaaaacaatttgtaagcaaaatatttcagtcagttataaactacagaagaaataaagtttcagtggcgttttttatttctcatttatttgagggttactgaggtgaaaggaagatggaaaaatattagccgttactactgctccataaaaaaatagaaaaaaaaaaaaaaaaacacttgtaaccaaaagctaagttcttgtccaataatatcactctacacacatacaacagaaattgaacatatccaatatacctattggatagataacacttacctaaaataggataataaaatagttttccattcatcaagagagactcaaagtcccaaagacttcaaggtcaacaagggtcttaactctagttaacaaggttataaataaacactgtataattaatttctagaagttaatttatcaggcaatggttctcatactttggcaaaaattcaaaattaccctatgttttaaccagaaataaataacagagctcactaaatcctttaatatatagcttaaatgataaaaatttttaaatcacaaaattttcagctcatgtttaacacttcaactttcaacttctccacttttttcatccctggctaaaatatatctttcatcctccaaaatccataaaatggaaacaaaagacagtctttctagagaagcattctttgttgttgttgataatactatttttctaaagtctacattctatccaagtctagcaagaactactggactactgatcaatatgtttaacctcatgctgttccctaaattgtcttttctccatcccttaaggcaaggtttatatgaatttaaaatgctgttttggagtaagacaccaacagaattctcaattcctgctgtttgaaatatatagtaattgttatatttgatatctaagcattaaaatctgaccagcatgcctctactgtcgaaacttaaggttgtttaaagtgggaatgggaaatatgtcagaagagagaggaagaagagaaacatacttaaaaaaaaaaaaaaaaaaaacttaacagaatctacctttccagtacatgttcattcagctgtaaccagttcatgtcaaaaagtcaagtttaaaatgttttccttccacccccttgccagtcattacccaggacccacaaatgttttcttcagcaatgccatataatttttaaagatctcaaagagcaaataatgcttctctacattcagagaaactaaatcaaactcagtcacctggcttctagaaaaacacaaattacagataactcacagaaagtagcaaaaacaaggaacacaaaaactagcagcaaatattacctaaatggaaaatacatatatgtagacaacagtagcatgaaatttagaaataagggaaaggataatccaaattatttccgggaactattcaaaaaggtgattctccatagaagaaaaaaaataggaaattaaattgaaataatgaattcaagttaaatttataaaattgcttcccaattctaatcataatttgccattagcatggcttacaatctatttaatttaaatcatgcaaacatgtctgtgaatacacataggtatgcactaaaatgcattgtttctttatggataaataattctataatcaaggtaaagaccaaggagttccttgtaggttttatacataatgagatacatacctgcggtatcacacaatttcacaataatttagcataccagcagaagggagtgtcaatcagcatttatgccatatcaatcaacgcctagagatatcgagaaacgttaaaaaactacaaaggttaacaggacattttgcctgtccaatgaagatatatcagtaaaatgataaaaatatactatatactgtaagaaatatgtttggtaaataatgggaatatggagatgctaaatgagaactaagacagctgaataaagtactaactaaaggattaataaaatggcctgatgaagaagtgaagaaggaagatctaagccgaggaattaacatgttcaaagacatggaacctttaaattacaagcaattcaaattttatgagcggtttgtcaaggtagaaaggggagtaacgggaagaagtcaagaaatgaggttgaacaaggagacaggagagagggcatagccttgtgtgtcaagtcacaaaattcagattcaaccagaaatagtgaaaatcataaggaattttatgcaacaggggcacaataacagaggcaatagattcaagttcagaagctgttgtagaagtaaatttttgagcaaggaggaaggttcaaacatttgaaatatgaagaaaaattgatagaatgaggtagaagaaaagcatttacaagaggcctcccacttttgttatttaactagatagaaagtggtaccattagcagacatacaaaatgtaagaagagcaacaggttttagagaataggataaatcctactttcaaaattctgattgagatgtatattagaatcattcattcattaaaaaaacaattactgactacctacaacttctgtcaactggagatactcatactcaaaaaatgagaaccaaaagtgagatgttcgtcataaggaagtaatctctgtgctctagttgatgttccaaaaatgtagcatatgatctctcttaatttgcatgttacagaaatcgttatgatacattacaaaaccaacctccctctgcgctaataagggtaagaaaacaaggaacttccatcttcttgagagcatctagttaactaaaggttccatcttagggcatcagaagcagtttaccccgatattggctcacatacttcattccttcaaagcctatttattgatgcctactatataccaggcactgttcttggtgctagacatacagctgtgaaaaaagatggaaatttctttgagagaaagaggagtcaagactgactccaaggttttgggcctgagcaacttaaaggatgaaattgtaatttattgaaacagaaatgaccacgggagaaaacaggcttgggaagagagaggaaatcagttttggagatgataagttggaaatgcctattagtgatctaaatcttaaaagctgcgaaggaaattgaagatagaagactccagttcaaaataaagcaattgccatagcaataatacgtaaaaaccaagacctcagatggaatcacgacagtatagaggaaaaaggaggtgtcagaactgtttagggcattttcaaccgtaggtttcaacatggagattagagaaataagttaaagaaaaagaaaagttaaaaaccataagtgaggtagaaggaaaacaaggagattgtggtgtcctggaagtatggaaagtggtctcaacagtgagagagtgatcaactgtgtcaactggtcaaataaaacaaggactaatcaattaccactgcatttggcaaaatgaaaacactggtgacttgacaagaatagtttctacaaagggatagagttactgttccaagcagaaactacttgcctccccacagatgccatatgcagccagtaaacaaacaattgctgtaaaatattctcctctttgccctaaatgcatctttatatgttagaagtaactgctcctttatctttgtttttaaaaagtctatgtaaagacacttatctctaggtgttatggattacaaattcaattctaatggtttggaaagccaatactgtaagctcactttattactcttgtgtcaattatcaaaaagggtcttctgtgagaaaaggtattttaaacgtaacttctagctggaggggtgtgtgtccatctatgattcaggatagttgaggatttccttagggcagcagtaaactaaaagtatagtacaaggactgacatcagcaaactccagacagcctaagactggaaagcgagcggccaaaaaggtaatgacaaagagtgggacaaaagtcagcaataccataaagtaggaaggtaaagacataacaggggccaataaagtagataagctgtaaatagaaatctcaaagatattcaatatgtggggcagagcgagtcaaaggccatcttaagaacagggcaaacgatcaaaggaaaatcattagaagccgaaagaggttaacaacaagatagaggaacatgccactacatctacatcactgaatcagcaaagtggctttctgcccttgaaaataaagtgagaagttttcttcatatgtgaatatatagtacctaaatttcctttggtacataatttactgcaattactatgttcaacacaaatatgagaaaagacaaatgtgtttatttgtacaaatttattgtacatgagaaatcttgttacatgcatataaggtgcagtgatcaagtcaaggtatttagggtgtctattccccaagtacaacatatttatttggtcagatacagtcactctattctgctatcaaacattaaacttatcccttctaccatatgtttgcaccctttacacacttctcttcatccttcctcctctgcccccactcactcttcccagactgttatctttccactttctacatccatgtgatcacaatttttagctccaacatataagtgagaacatgtgatatttgtctctctgtgcttagctgatttttcttaatagcctccagttccatctatgttgctgcaaatgacaggagttcgttcctttttatggctgaatagtattccacagtgaatatgtaccacattttctttatccattcatccactgataaacacttaggtttattccatatctttgctattgtgaatagtgctgtaataaacacatgagtgccagcatccctttgaaatatttatttattttcttttgggtggatactcggtaatgagactgtttttttctaacctttggttccctgacccttttttggacaacaaacttaagcacaaaattcaaggttcactaacaggtactatccctgagccccatccacgaggaccatccagtttttccaaaggccgacagagcagaagctttcaacctgattgcgctgatgagatttagaaagttgtctaatagcaaaagtaagtagttcttagaaagtttactcttgagtcaacatgttcatcctgggtataagtagatgtttttacaattaaatcgtggctctacaatgcaacaacatatcagcttcaggagctaaatccagattgaaaacaagaaccagtaaaatacttaaataaaaattctatcagaggctgcaaaagcttattatctgggcctggaagatacagtttagactgctattcatctttcctaccccatagcagaaatcatctgtctctctttgcacaattaaatttcacatttatcaagttaaaatgagtaaatgatgcttatggagaaatattttgcctctagtgtaaatagagaaattccaaagattttaaaattttatacacatgcattgaagtaactgcatataccccacattgactcagagaaataaaatgcaggactcaagaagctataatttataccagggatactaaagaacaaacttgaattcttaaaatatttatttgaaaactcccccaagacatcattaatttcttctatgtcctcccatgcctttttctaaaactgcctttattgcaattttcgtatgaaatgttagatggctttaaattcttgagtataagcttcttaagggcagaggtgtatttcactcaactttgtagttccaatacccagcatagcccagtacctagcagtcactgaataactaagtaattgatcggttaattatgaaactttttagttaccttcaagacattaattatctttctagttgtccactgtagaataaatgaagaaatgtattatatagacttattaggtagattcagaaaactgccagtaaactctagataatgataaccattagtttatacttgggtatgctccatatgataatatgagttcacattagaatattatctgttcctttaatgtctactagcatactggcttattatttactgatccattttaatatggttgatgttttaattgattggtacttatatatcaaccctattcatgcaaacctcaataaaagtagtagtcagaagagaaaggaattaaaacaaattaacatttgcatccttccgggatagctcaacaatgatcctaaaaataagccttttactaatagtctgtattcttcatttagtccttcactaaatgtgagaaaagtttatttaaaatagaaaattaattaataattatttgatggaacagaagagacacttaaaacaaaaaatagtaaatcaagatataactgtttattataagacctttacttggtcttgggcataataaaacctgggtaaactttgaagattaaagtggtaggtggaacaaaatcaaccaaagcaaatatacttggctaaatccagaaaggcatttaacctctaatttgttttaatgtgagtattcaatggcatatttgtctgattattgcccattgacaaatttcaaaatatagtgattatccctcacttaagaaaggtttttggtactatttttgatactttaatgaaactatttatataatgataaaaagttatcctttttaatttataaaaatattgctttttctactttttcagacatggaaaaatgcaatcccatcaaactttcaaagatctatcttctaattaaacttaatgaaatccacagattgaagagtttttttttaagttaaggaaaaatttaactatctttgcagcagccataacaatgcaactctcagtctttgactgcaggaaacataaatggcctacagccccagctgctaccttctgaaagctatcacagcatttgaattgaagtcacagttccctgctcccagccaaggcttgagcacagcaagtatactaaaatagacctgttcctgggacacatgggactttggctcaaggattccccaacaggcttgtcaagctctcttagaatttcagggcagcctgagacactttcaccccatctccactccttcccactctccttcacctagagtcagatctgcattgagtttgacagttctcccagcctcccccagctcctcctccagggtctctcacaggcatttcctctagtcccttacacatcaaacctcttgcttctcatagaaccaagactaacagcctcatttcacaatgcaagtttcaacaagggttatcattttcaaattgtcagactcataagtattataactgaagcttaatcaaatttcttattttttaggtatttaacagaacacttttgctttttcttcttgttctttatatatgaccagcttctgtattttcatatgttactatgagatacgggttaagaccatgtgtatgccagacactgaaatacatttggaacacagattttctctagtaatatttccagagacaccaatagcctggattatattccttgcttttgcttccttgaaaaatatattctagggtagagaaatatctaccacaggaatcctagaaagacataccaaccatcaatcacccctgtccagtactgcatcactgttatcaccatagcttaagaagcctgaagatataagggttgcacaacaatgtgaatgtgtttaatgtcactgaactatactctcaaagatggttaaaatggtaaatttcatgttatatatatcctaccacaataggaaaaaaaaaaacctaaagcaaacaatggctatgtatttcaacagtgggtaaagaaatgacaagatctgggtcatctttactagataatcataacaagtagagatccacagaaggacaacataaacccagctattggtattatatctaaagagtatactaaaatcagatatttagaaccctgaatgaaattaagtaaaaggatttaagtatatattttaagtgagcaagctcagaactaaagatgctacagattcacatcaaaccatcaaagacaaccaaacaattttttctctctgaaacaagcttcccatcttttcctttatttgctctctgacataattatttctcctctctggactcagaaactttggaaatcatgttttccctttattcagtaactaacatagggaaaatattcttgaggtatttccaagaatcaaaattaatgagggtttcattccattcaatctacatccaagataaaaccaatgtataggaacaacattagaagaaccgggctaaaggaaaagtagccaaggtgacactaggagatttgtggtcttctgtctgttgcaagacaattctccctgggtctctcatatttcatttccacttgtattgcaagtaaagacattgatggtctttgatctagatgctcttcaaggatgtgtgtatacaaaacaatcttggaaaacagcatatctctccagagcaaagagcaggctcacttcatgtctagtataataaagataatgtcttttagagcaaagtgcaggcaagttcaaagttcctctcctacagcacatcctgccatttaccaccagaaagttctgaccatgatttgattaccattacctacactttactaagaggtcaatcagaatagatccagctcctgcatctcccatgcaaaacatcttcccttctctctggatgtcaaccccattccaactcccataactgtagctcagtcattctgtggagtgggtgaatggcactgacaaaaaggaataagttggactgactgtcttcagacagtccctccaaaaattgttagacttaattatttcctgaaccaagaactgtaaaatttatcagccacctggaagccaagttgaaagctctgccaccctgtagtcccttaactaataaagttcctatttgggtagtcccaacaactacaaacaacactttccttccaggagcaccatgtacacctttcaagactatttatcttatgtgaaagacaggcattaacttgcctctctcttcaaaaacaccatgacttgaaccctacaggtatgatcataagaaatgttcaagtgtttaaagaaatgccaccagtatgtcatgcaactcttaggcaactatggagttctctccaaatggaagctatgcttagttactctggggagcttcctggagaaaaaaactgacttactatgtgtactctgcaggcagttatccctacaatgggaagtggtaaaaaatctgtgcctgatttcagctaaagtgatcagtgacaccacatcagccctgggaggcaatcaggtcagcttcaactcactgaccaggattgttatgaagaaagaattgtcctagacttctttgctgaacaaggggaagtttgcgcaatcactaacacatcatactgtatctgaattaacacctcgggccaagtggaaagatgaatcaaaaaatttaaaaagaaagccacctggtgttctaaggtagactctgatgatttactggattatgggatttgttcagctgactagatctgggacctggaaggcaggactgaggcaaatacttcagacaggactcattctgctgcccacagtctctcctgaacttaattaagtatgctatgaaacaaactgaacagatttcatcatagcctgtatcaatcagatcaattacagtcattgctgcccataatataaaagtaatattccctatgctcaaggtttctctcctaaaacacaacccactgcaactggcagtattcacattacactatgagtgtcacaatatgggctttgggactgacacaaagctgatactcagcctactgctattgctgtgagcaataaaatcctttgtttttaacctaggagttcacgtcttttgacagcaccaatagaactatgacagactaacatgtcagtttacaagtggcagatcgtctaagaccattcatgttcctgaccctcccatcagcaacttcatgggtactggatcagggagaaaccacaggaaaaggaagttacagcattctatcactgcagacctgaggacatatacacagaagaagaaccaaatatccacccaaaatgctctaggattcccatgttttggttcccttccaaaaatatatcacaattcaatcagtcgtatgaccaacagcaagggtttcaacaaactctttgaaatctagaaaatgctcttgatactccaggaaagtatgaccctgacaagagtagacagaagacacagaaaggaaaagaaaaagaggagagaaataaaaataacagaagattaaaggacggcagaaactagagattggttaaccaatacttatcccagtccttttctactaaggaaaaactggccaacatgagggacaagcacacacatgaacaatggacactacgatggagggtttggttctcctggggcaactgtggcagaaggctgtctgtccctggtgtcacaagtgctgaccacagcagagagttgggagtggcacttccattagagcattgctgtgatacagtgcagcgtatcttctgtattacttctagctacagaccacccacatgattccctgggcctaccagaaattttgtaaggtaggtacaaaatttgtgaagtaattaattgatataggctatgatgaaatctgttcaatttgtttcatagcatatttaattttgtaataacattttctgcttaaattacccagagtgattatgttgcttgcagctgagaaaccctgtctgatgtttgaaaaaaaagtaatgtatgcttattttaagtcctagatttatatttgtactttctttcctgataatatatatgtatgtgtgtatacatatatatatagatatatctatctatctatatatagatagatagatagatatagatatatatatattttttatgagatggagtcttgctctgtcagccaggctggagtgcagtggcgcgatctcggctcactgcaagcaccgcctcctgggttcacgccattctcctgcctcagcctcccgagtagctgggactataggcacccaccaacacgcaaggcaattttttttttctttgtatttttagtagagacggggtttcaccaggttagccaggatggtctcaatctcctgaccttgtgattcgtctgtctcggcctcccaaagtgctgggattacagacgtgggccaccacgcacggcccctgataatattcttcaaggcctgagaataaagttattccaagtacaaagtttaacattttcttactatataatatcaaatgggggaagtgtgcacaattctatcataatcataaacaaattatcattattaggatcagaataacaaaaaagtaacaattctccttattctcctttaaaaaaaatactttgtcataaatatactttgcagtaaaagaataatgaagaatgtgtttattttgctatctcattttctccaatttaaaagtaaacaattggttcctattttattcaccaataaacaagttttatttttaattggcgatttgctaatgtcatctagtttagcacattttaataatgcaatttattaaaatggaataaaatgggtacaaatagttttataggaaaattgatagccagccacctcaaaatttactttatttgtggaaaattcagaaagacagagaaataggtatttttagatattactacaatttttagaaagagcataacctgcaatatgcagaaaagagtatctatgttacctttttttgtttgtttggcctaagttagcactatagaaaatggtatcttttactctgaagcctgctacctgctagctatttcacacattaggcttaaaaacaatgagaaacctttattaaggagtaaaagccttcaacaaaatatttgaatagaaaaaataagaatgtaaaacaattctttccattttctattcccaattaagagcatggaaatttaacctgaacatatcagaaaaatgagaaagaaataaatttgaatgatgctaaaataatctttcacttcttaaaaattaagctctaagaactatatcaagaaatttattttagtgtttacaggatatcaaataattaacactactactaactgtaacagaaaatataattacaactaaagcaattagtttcataaaagcaaatataatcagctacttatatattggcaaaaatttttcaaaaattgaatcatcacctactatgtcccacaaaaattaaaaattaaaaagaaactgtatcattcccgtgacttccataactacggaaggaaaacattgctctaagctctcctcctccctacctctattcactcaacactaaatatggcaaataagcagtagtttaaaaagaaatcaactccacaaatgttcacagcagcatttttcataacagccaaagagtagaaacaacctgaatgtctgtcgactgacagctgataaaatgtggtacactcatgacagacgattatgtggcgattttttaaaatgcagtactccaacatgaacgaacctctaaaatattttgctattaataagtaaaaaaagccaatcacaaagatccacataatgcatgattacatttacgtgaaatgtctggaatatgcaactctataaagacagaaagtagatcaatagttgtctcaggctagagagaatcaaagattgtggagttatagctaagggatggggactttcttttgggtggcaatgaaaatcttctaaaattgactgtggtaaagattccacaaagctgttaatatacaaaaaatattgaatcacactttttttcttttttttgagacagagagtcttgctctgttgcccaggctggagtgcagtggcatgttctcaactcactgaaagctccgcctcctgggttcacaccattctcctgcctcagcttcccgagtagctgggactacaggcacccaccaccatgcccggctaatttttttgtatttttagtagagacggggtttcaccatgttagccaggatggtctcgatctcctgacctcatgatctgcccgccttggcctcccaaagtgctaggattacaggcatgagccaccacaacctgacctgaaacgcacattttaaatgggtaaattttatgatacgttaatttagtctgactagagctgttaataaaagaaattaaacctgtatcaaaactttatataaacagaattcttaatatttatttaagtcttaatatcttctatagaatagtaacctataaaatcccaaacttttaactgatagttctctttctagatatttactgactaaatataagtttatcatgactatagaaatgttatttttccacagaagagcaccttcaataaaagcagaactacctataaaagaaattacttaatttaccccctaaattttttaaatcaacgtagtttgccttcaagttcatactcatcaatttaatttgtagttaattaaaataaaggtcagatatatttacctttatgtctaacagccaaaacaaatattccaaataaccaagaattagactgcaatagtcgaaactttccaataaatgaggagatcatgtcatttaccaggacaaaacagggctttgtctttaacaagccattatttatctcttcccttacagtttaaaacctcatgtaatgtaatactgttgtaaacaaaaggatgggaccccagttttaccaatattttcataaaacttttactctcaaataattatagattcatagatagttgcaaaaaaaaatcagataaagtaatggttcaactttcctctacaaagttttctttagggctactcttcattaatcttcagatgaataaaaagcctgggaccagatgacaaagaaacttgttcaaagcaccagatgacagcagatcaacctgacaaggaaagacataaaaaatagaaaggaaaaagaaaagcaataggaaggaaaaggagagcagggaagggggagctcagagatgaggtgggagagaagagacaagaaagcaagagaaaagaaaagaggaggagactggaaatgaggctagcagtacatgaattaaaagactctagtctctcaagcaactaaatgggcaaggtcgatgtcacagatggggaacacatcccagacctcgaagccaatgtcatctaacaagcccagaatgcatgaaaaggggctctcttacagaggttcctgcaggacccatgccatagagaccctctggtcagatcttcaatcctgcctattcgaagagaaccaaatcacaacatagggttcctcactggctattcactaacactgtcatctgaaatgtcatactaaattattagtttcacagctcctatcatattctcattttttttttttcttgagtcagagtctcgctcagtcacccaggctggagtgcagtggcacgatcttggctcactgcaaccactgtctccggggttcaagtgattctcctgttttagcctcctgagtagctgggattacaggcacctgccatcatgcccggctaatttttgtattttagtagagatggggtttcaccatgttggccaggctggtcttgaactcctgacatcaggtgatctgcctgcctcagcctcccaaagtgctaggattacaggcatgagccaccgcgcccagcctattatttttaaaataccatttgtttacttttaatttttcactttatttttttatttcagatttagcttttctattcctaatataccaagaaacaataaaatggccaagcacccagaacctttaaaaaaaaactataactttttacttttattaagtgtgaaagagatttacttcatatctattaacacattggctttgaaactttgctgcacgttaggatcacctgaggatcattttaaatttcccaatgtccaggtcacaccatgccaattaagttttagaagtacggaggtgagaatcaggtattagtattttttaagatgaccacttttgaacaattataccaataaaagcctcttttcctttttttaaaaaaagaaagagaaattaaatgaatattattcagcttgaatacttaaatgtttaagtctaaatgtgtctttttagcagtatttttggaaacatctataaccttgggtttccttattattcacgtaagctcaacttttcagttattaaaacaatgaaaagccctaatcgacctaattggcaaaacatctcaaaagttaaagtaatttaagagactaacatagaataaacagttcatagaactatgataatatctcatacagggaaatctaataattctactacacgaaaagcaacctaggaaataaccattgttgtgtgccaagatgtatctataagataaattatgacacagtacaaataggaattctatattctaaaaataatgctaggccggacgcagtggctcatgcctgtaatcccagcactttgggaggccgacgcgggtagatcacgagatcaggagatcgagaccatcctggctaacacaatgaaaccccgtctctactaaaaatacaaaaaaaaattagctgggcatggtggcaggcgcctgtagtcccagctactcgggaggctgaggcagaagaatggtgtgaacccaggaggcagagctttcagtgagctgagaacgcgccactgcactccagcctgggcgacaaagcaagactccgtctcaaataaataaataaataaataatgctataaaagaatattaaaaggcatgcagagcttcataacaatgttttcatataaaccaatcataaaaccgttaaaagtaatatatgccatttaaaaacagattttatatacacacaaaacttacttgcagttgaactgaattgtgccggaggccttccacaatacaaaaaaatctgtcaatttttttttcttcaccagctgaagttaaagcttctaaaacttcttcaaggctattggaaaatttgagtcaattaaattgcaagtagcaaacacaaatgccataatacaattgctttatcctactaaagaagtcaataccctaagcagccaatatattttagaagtagattactgagtacataccatgtatcaagcacagttctaagcatgttacattttaatcatttatccctgacaataaccctgtgaagatgtttatcaagcatttatataatgcttactacacatcaggcaccatttaagccactttacaaacatcaactcattttaaagtatataacaattgtttgaggtaggtactataattaacccgtattatagattaggagactaaggcagaaaaaggttaagcaatctgtccaaggtctcatatctgtgaaatggtggagcaagaatctgaaaccagacagtttatgtggtgggcaccatataaatgctctcaaccactgcactcttatgcctcacaagtttaagtaaatgaagctgagtgatagtcgaaaatatataatagtatggtattataaatattcaaatataaaatataataattatgcaaaaactatacttcctcttcttttaagtaatagttaacagcatccagcacactggagaagctcacagttcgtggacatgggcatgcagtcctaaatgttacttacaggatcttgatacccattctgaagtcaagaaacaaggaaaagggaaggataacagaatagggaagggaaaagaaaagcaaggaagagtccaagaggaaagaggaggaagaaaagggaaaaagaggaggttaaaagacagaattaaaaaatgatgggggaaaggggaaaggaagaaagtgggaagggaagctcagaaagtatcatatgtccacataaatttcactcttagatttgtacaccaacatttatatggccttaaatactgaagctgtatgcctggctttgcacgcttgggactgctgctgggtgtggcaacacctcttctatagataaacactgtaggcacactttgcgggcagactgccaggctgaggccgagtggtgtctttgactatccaaccatcaagccgaacctgctcaatcccaccaactccagcaggacctccacaaggctgattttcaaacgaacacaggaggctccccttacaggactctgccaacccctacatatgggggatatttctgttagttcttttgcctgtttagtttttacatttttatcttttttaaaaggcattttaaataatttttaaatgcttcctgataattagaaccctaatttttaaaaatctttatctttataattatctttaatatgtatgtaatggtatttaattatactcctaacaaatgtggttaagttctttacagctctagtgtgtgctttatgctcaaggactttgtaccctcaaccagtaaactactattacataaatcactttctaatctgccttatatatagatttccaaatcgtaatatgtttgcttttacaaggggatagagaagacctacagtttgaaataattctatgtggggaaaaaaaatcacataagaaatagaaccatttgtatattttcaaagcctccatttagaattttttttaatttagggtttcagttaaaaaaacagtttaaatatgataaggaaatcagtttttcatagaagtatgttagaccataactaataaatcaattaagagaaataattactcaaaaatttccagccaataagaaactatattagctgcttaaatatacctcaacatttatttaaattctagtaaattctagcctagagtagataatgaaacattaaatgaatcaatctgtattaaattattatataattaggggaatatgttgataacacttacatgctttcttcccctacaatgcataccgcagagagaagtttaaccacatctgtcatcatattggggtgtctgggatccacggctttggccaataaggaaaggctcctctcctcactcataattctttccaagccatactataatattttgaaaataagaggtcaaatgttagaaattagttagaaaaataataccctgaaggaaatgtagttattaaaaaaaatttataggacatttttacacttactaaagctaaaaaatatagactgtgtaacactctaaaaagttcatggctgggcacggtggttcacgcctgtaatcccagaactttgggaggcagaggcgggcagattacctgaggtcgggagtttgagaccagcctgagcaacatggagaaaccccctctctactaaaaatacaaaattagccaggcatggtggtgcatgcctgtaatctcagctactcggtaggctgaggcaggagaatcacttggacccgagaggtggacattgcagtaagccaagatcacgccattgcactccagcctgggcaacaagagcaaaactccgtctcaaaaaaaaaataaaataaaaagttcataagggtattcactttatgtcaagaaccacaaaactaaaccaaataaagataactcaaggtgatcttacaacaatacagctgacaattattaagacaggttaagtagccaaattgagaaagtgggaagcagtcagaaacatgggatttgccaacagaagcatatgaaacaaacagccagatacggaaccagacactgaggccatgaaaatctttttcctgggaaggaaggttggtaagagatatattatcataagcaaacacacagatcaacactgtccaagagaaatataatgtaaaccacatgagtaatttaaaaatttcaagcaagcaaaactattttcaataaaattaatccaatataccccaaatattaccatttcaacatataaccaatataaaacatttattgatgacatttcacttctttttcttcctaaatagttgaaatccagtgtgtattttatactgtagcacatctcaattcagactagccacacttcaaatgctcagaagccacatgtagctaccatattacaaaatacaggcctagatattagcacttagttcataaataagcaaaaactgaaggatgatttgagcagataccatgtagaaactgccacaatgggcacaggtattctaatcacaatggtatttattataaggaaaacaatgcagttgtaaactcattctataaatgagacgattgggattaggataaagtttatttactactgccaggaagtcaaatccaattagaagataagttatgttaatgatgtatctatgaaagataactgtcaaaatacagaagatgaatagaaacaataaaacagtactatttatctagcatgcatctcagaggatcctactaaagcatgagaactgactaatcagagttactaccaaacactaaaaaagggccttattcccaattacaagcctatgaactaaactcaaaatcagcactacatgtaagcattgaagttgaatctataaccagcttagacccaagtactttgattgtgataaaatcctatttataactttcctatcttgtatatggccatttatgcaaagaaaccttgtactgggctgaaatactccatttactttaaaccactatctgagaaacacaggaacaatggagaaagtatgaggaaaggccaagggcccaagaatatgaattttggagagattactctgtcttgttagtaatagggaaaagtttacaacaagacagctaaacagtcaggaaatacttacttttatgatagcctgggctattacctaactggaaaaagaatgaaaaggcaggcacaggaccagaaactacaatatgccttgctaatcattccagggaattgtcaggtttataaagtaccacttagattcaattcagaaagtcagtcaatgattaccaagtacacaagagctggctctgtcctaataaatctgggaattgagtaaagcttgcctctagcatttccccttcttttcccacctacctggttgtccttagctaacacctgcccttctagaatcagaatcctgtgactcctccagccacccaaggtgactcatgctgacttcctccaagtgatactacctgccttctctgccaaaccctctggccctaacctatcatgtatgaaaggtgaaataggagcatactctgatttcacagttttaaccatcatcctgtgaccccaaaagtccatcacaggtaacgttctctgattttggtaatgcaaaaatgtgtcacactcattttaagactggaatgaggccaattactactactcagtatctataaatacagaattgctacttgtataaattactctcaattatttaaaaaacatagcaaaacaaaacaaaaactgttgactctgtgtgagaagttgtcaacttaccagtgctcggattaaagtgcatttaatgagggctgttttaggttagagaggcatgacaaattttgaaaggtctaaggatgtatctttcctgaatgtcaaggacccactccggacaatatggtaactggcctgttctaaactgaggatcaatgccaggttcc

SEQ ID NO: 590 - DNA, 389823 bp, Homo sapiens
tgcaatttataaatacggtttattaccatggttacaaactttcagaacaggcctctgagacattggactgagactctgccgaacatctgttaaaaaaaaaaataaaataaacttaatatagaggtctgggcatctcaagaaggaaaacagtattagacatacttttttccaaggttatgtatttctggcagcaaagtaatgcttcaatatcctgaaatacttgaagcagtaatgttatgacttttacttcccatttaattatgctactgtaaactccactgggataaggtacatatggttctttagatgagacttgtcacactaattaggattttctaggttcagtgcattgatttgttaatgtgctactgacatcggccaactggaatgcatatctctctgacatttgtctgtgcaagggattaagcaaacttatgaaacttctgaacagttgttgcccacggcactgcattcttgacacacaacttcaaaagaatgagaaaaacaggattctttctctgtgatagctccctagaaagtaacatgaaacaagtatagggttcaccttttggcatcggtgtcctttttcttctgtcgcggaaggcagccccggactgcaaggcctccagcagattatccatcactcctgtctcatcaccctctgtgaaaagagatgcagggaattccatcagccctcagggttaccatagcaatgtcaaagcatatacaaaaactggtgatggtgatggtagggagaaaaaagatcagatgccaggactaagctagcaatttcaaaataggacaggactttaactctctcattaaatcaactatcttttaatgaaaactgcctcattagtgcctatgttactgtgcactaaagggaccgagttccacggattcacttcagagcactgcttttatagtccaacagcacaattaccttaaatggaatgtggttctagtcatgtttgagtcttgagttataaatcacatttcctttgtagagatgagctattttcaaggcatcatcttctattctaaagtcaaccaggtatgggagagagtagtttttgttttttgttttttgttttttttgagacagaatctcgctctgtcgcccaggctggagtgcagtggtgagatctctactcactgcaagccctgccttccaggtttacgccatcctcctgcctcagcctcccgggtagctgggactacaggcgcctgccaccacgcccggctaattttttgtatttttagtagagatgggctttcaccatattagccagaacggtctccatctcctgacctcatgatctgcccgcctcagactaccaaagtgttgggattacaggcgtgagccactgcacacggcccgggagagtgtttttgttgttactgagattctgctgtctaaacttagcagacaaattatatttccatgctaacttttaaatataacagattatatttccatgcttccaacaattgatttttcatatcagaagataatcatcccctgacttgaggtgacacagaacaatcactacaaaattttacagaacgtatagtttatcttctataatgagaaataaatcaaaagaggctctctgaaatcaaaaggactgcactccattaagattactttaaattgatatcctgtatataattaaggaaatacgtggatatagagccaattatctctacaaagaacagattatgcctgtaatacttataagtatttatagttatcaatgttaaatattgttcaaagagaacaggagaaaaagcttcaaaggaactactggcccaaaccaaattcaagaaaaccgtaaggactttttgcccgtccagacaaggtaacttgcaggcattctttatgaaattgtatggctggtatactgctacatttaaaataatggaaagctattttccttcgaacttttattttttcctttttgatacacaatccctttacagagataagatgaaaagtgaatgcagtagaatacaaataacatactcatttacagtttataaacagatatataaatataaatatgtatcagccccttttccatctgctgctatttcatatttttagaagagtactaaaccttgtaggtgttatcaaaaaaggtgggtgagaaatagaatatttggaagttgtgaatttacaataaatgtaattctaagtgatttgatggctattttaactaaaatacattaaatatttcagacaaatagctatttgaaaatttattttcaaattcaactatatttttccttaaaaaactgcaggtaatgtcaaatatttaagatagtaaaagaaaaagaaaacatttcaaaatctaaaattacaattttaaatctttttcaagcagtcatgagattgaaaaaaaatcctagtactgaaatcaaatagaaacaaataaacatgttttcatattgatagattataaaggagggggaaaaaagaatccaagtaacttttgaatactttaatggcataaagtttaagggaaaaaaactataaagaaaatgtgaactttcttcttagtaaatttattgttggtagtggtattgatgtagtgattctcagactattgtgtgtgtataaaagctggagcagatgtgtaaatgtgccgatgtgctcactgtgggaaagaaaatggaaatatggaattggagaaaaagaaaaagaaccaagaagggttggattggatgtataggtattaatgtaagctcaaggcttaacaaaacaaaacaaacaaacaaacaaacaaaaaaacccttttcctataacactatagtagcatcaatgagcatttggatcttggtttctagctaccgttactagtcctaaaatcttcgtttctaatgacctctctcgccctcagatcttggtttctacataccattactccctaaaaggaatgacaatgcttacagaaatggctgattctagaactgaggccaagaaagtgtgaaatgagtcagaaacatattgttgtgccagaaaataagaaagtgctcaaaaatagatagtgatatgttgaaaagacaaagaagccagattgaaacattgccttggccaaatttaggacaactgagtatcaaataaataatcatgggaatgggattattgcacactgaggaaaaaagaatcatgcatccatagtgatactaaaaaatacatagtaataaaaatgtaggaaggagagttcctctttaaagaacagtgtcaactaatagatgtcaaagatatgagggaactacaaaattcaccacattacaattcacatagtaagaaatgattcaggcaggagtcatcaacggttgcaaaaactattgtgcataagggatgtagaggaacaggatatagagaaatctggtagataccaccttatccaaataatcaaatttgacattaccaacaatgtggaatatgctgatatcaattgcctcctgaagtgatgcacaacttaacctgtgtagcacttcgcacaaaaatatttaacttgaatctgaatgcaaggcaacaatcatagaagtccaaagtaagggacattctgtgacacaactggcctaggatctaaaaatgtatcaatatcatgaaagataaagagaggaagaaatagagaaagagagaagaaaaggctagagaactgttctagattaaaagagactaaagaggaacgacaatgaagtatagaggagtccctgattaacccctgaattgaaagaagttatatatgacgttattgggataactggagaaatttgaatatggactgggtatcagataattacattgtaccaatgttaagttatcagagtgtgataactgtattatggttcactagaataatctcattgttcttaggcaataaatgctgacagttttaggctcacaaaacaacttacacagtctcatgtttattacttcatgcctttgaacatgctattatatctacacagaacatctgtctcactttcttcaccaagctagctcttacccttccttcaaaacggagaactgagaatcctttcctgacccatgtggcataaactaggtgcccctctgtgtcccagtggtctgtaatacatataccaataaattctttacaatgttatattgtttatgtgactctttctaccactaaaccacgagcccactgagggcagggattatagatttcatttatcttcaacacctggcaaaatgcgactattatatagagagtgttcaataaatatatgctggctaaattagctaaatatatgttgactaaattagctaaatatatgttgactaaattagctaagatggtcagctggaagggttgattatgcatgagaataaagctcatagatggacaggggtccagggaagagatgggaatacattcccgccaccattctaaacaacacagctttctttcttccttttcccttgtctcatacatctatttagttgtcaaatactatagactgaaactccccattatctcctgaactaatctgctgttccttttctaactacactttatgttggtattacagaactgaattattttttatctggaatactgcatgagttgcctagtcacattgcttccagtttctccctaattctgcccatgcattactgataagtaagtcctacagcagaaatgatcttcagttcccccggtcacaaagtttcaatatatctcagttcttacaatataaagttccaactctttttttcatttttatttttaattttcttttttttgctcaaatggattttgacagataaagtccaaactcttattcctaccccaacaatgatttcaattgtatttccaattgtatctcttacttccaaccatcccaacctgttctttagctaaaggcaactgcctgtgattctctacaaacattctttctctcgtccatcactgtccacctggaacctctacccctgctctcatcctccagagcagatggctatttttggccttcactctcacatgcataatgggaagaatacaataatgaagtaaaacaacttgcattctagtctgagctttcaactaactacctgtgagacactagactattatatacataatcattcctgacatatgcaatacagacaatacctgtctagggttaatgagggaatcaaatgagataatacaaatgaaagcacttgataaattgctaagtgatatacaaatatagggaaagaaattcacagataaaatccatggtaaattacaggacatgtatgaaatgcctgcttattattaaatgtttcaagcactgttttagatatgttacaaatgaaggaagtctttttctttttttttttttgagatggagtcttgctctgtcgcccagactggagtgcagtggcatgatctcagctcacagcaacctctgcctcccgggtccaagcgattctcctgtctcagcctcccaagtagctgggattacaggcgtgccccaccatgcccacctaatttttgcatttttactagagacagggtttcaccatgttggccaggctggtctcgaactcctgacctcaggttatctgccagcctaggcttcccaaagtgctgggattacaggcatgagagtcaccgcgcacggccgagggaagtcttttatagtgtattctattacgctcttcattaggtataacatcatttctaagaaaaactctgacttgaagtacaaatagactcttgaaataaaccaaagtgtaagatggggacatataaagaagatgttcttccaaatgttaaaaatgcatttagaacattcaaccaacacatgttcacctggcatatggtacggtgtgccaggatgttactaggcactaaagatacctaagacccatgcatatggtactgtgtgccaggatgttactaggcaccaagatacctaagacccatgcatatggtactgtgtgccaggatgttactaggcaccaagatacctaggccccaaaggtaaacacaaaagcatttctgctctcacaagcagaaaagtgtatatatgagttactggagatgtacagcttcctagtgaatgatgactcgaagaataagcaggagttactcatgttagggactgtagagggaatagcattcttggcaaaaggaataacaggtacgaaggcaaaaagtatgaataaaaacaaaaaatgaggtgtaataagatgtttagatgatttatatttacagtattctaacatagaccagagaagttaaaattagtcagtttttcttagagtagaattcaatttctccagctataatttatattaaaaatatttatagtttctcccctgctgtgaaaactcttaaataactagactaactgcaaaagtcaaagatttcctatatgtgaaaaacatatcatcttaatttgtaaatggtattttaaaaaattgcactgtgtcaaaggaaatggagaagggagagttaaggacatttctaaagtggaatcaataggtcttaggaaccgaaagaaggcggaactgctaaggacatgtctgagatctctgcggcccattgctggagaaaagaaaatatgaaatttaaatattattgattttgatggggaacaaagattggaaaatataatgagtttccttttggacatgttaatggaaggtgctagcagggacctccagtaacttctggaagacagctggaaattcgggcctcaaattcagacaaaaatgtgggtaatatttttggaagtcatttccatattgtaaaaaatactcattcagcactctggaaaagtatatgcctgaatcagaagaggtggcatcttggaaaccacctaagtttaaaggacaggagaaaaaagataagtcagtgatccagtaggaactctctttccttattccattttcttcagccacggtacaacctgaaattttaaataactaagcatacaaagaagatcctaaaaggttctagaatgctgcaagcaagtaaacaaatgaaaacaggtcaaatatgtaggaaggaaataagactaggactggatttctcagtggcaacactgaattccaaaagataggcaagaaatggtttccaaattctgaagcgaaattatttccagtgaagaaatgattatgttgctaatcagacaaggatagaaaatggacatttttcaaacatgcaagtgtctatacatgccatcttagaaagagactgcaagatgtgcttttgcaaaaccaaaacaagaggggtagaatagtaagaaagaggaaaacatggcatccagaaaaggagaagggacaagagagcaaagtggcaaaaggaattcccaggatgtcccagtctcagagcagccagtttagatcacatggatcacatgggaggaaactgggcagtgggacagagtagtggccacagaaccggtagcaaatctattgtgtcggaccatttgcaaaatgattgctgattatttcccagatccattgaagactttggataatacagtaacaggtatgtatgtacaaatactaaacaaactttttgagaagtctctattaatctagaaacaacaagattgtcccataggaaatgctgtagtctgaatgttagacttgatctccaatgtaatggtattaaaaggtagggtctttatgaggtgattaggtcaggagggcagaaatctcatgaatgggattagtggccttataaaagaggttcaaggaagctgttagtcccttccaccacatgaggacacagcagcaagacaccatatatggagcagacagtgaaccatcaccaggcataaaatttgctggcatcatgatcttgtatttcccagccttcagaactgcaagaaataaatttctgttgtttataaattacccagtctaaggtgtttttgttatagcagcaggaaaaaaccaggacagaaacaaggaatactgaaatttggggtaaagaaaaaaaaacttaaaaattaaaagaagaaaaataaagaaaacaaagtatatttacatagtgccaatattataaacactggccattctgttggccatcaactgtgatataattataatgaaagacaatggggtaaaggaagaggggtaatccacacaaggtggattagtggtgagagggcattagggaactaaatcaggaactcagtaatgtctaaaataaaaaattgatatgcaacagtctatgctattatctagaaataaggaacacataaatatcagaagaaatatctaagaattaaaagtgattgcctctgggaagtgggaggaggttgagaggagtgagggagaagatattttatcatgctatgagcctattatatttaatttaggaatttgtagacattgataaatacaagatagttaaaaattttattgaaagagaaagaagatggctgaggaagagaatttgaaggaagaggttgattcttgacctaaagatgcttacctctgagaaggggaggaagacaggtaaaaatcgtaaaacacaacaggttgaatattatgacagagatattcagaatgtggtacagggtggtgggcatgtagtatggggcagagggagaaggaacagcagttacagaaggctcagaatatctgagacttaaagaaccgatttaagagtgccagagctgtcaaaagagacaagacccagctaaagctgtcaggaaagctgtacaaggcagggattcttgaagaatgtgcagtggatatgagtaggaagagataacaggggtaacgctgcgaggtgaaggtgaagagagagccggggccaactcaccaagggctgaatataccatgctatggagtttagactttaaaggagccatgaagtcattttaagctaggaagtaacatggtcaaatttctactttagaaagaatattttgagaagagaaaagactaaaggcaaaaaacaaacaaacaaaaaacaaacccaagaggcatgtttaatgatttaaatctagacaaaatgtgatttcagggcccaagtaagttacagaagtggtgaaaatagaaaaaagaaaggaggagacatagagaaatcttggtatccgtggttgtgaatattataaagaaatagttaaggctgatttccaggcatttggctcagccaattgtatatatattgatatcatttgccaagtacagaaccgtctttgtttgatgatagaatgagttggatctagacaggagctcaattttggatatgttaagttgaaatgttcatgagatatacaaatacaaagtgattcaaggcttctagagggctgatagagtcacaggtttaaaacttgggaaagaggaattggttacactaatacattcaacttagaagcataggtcgtacctgaaactatggaaaagagtacaagcatagtaaagtggtagagaacacaagttctgaattcatccatttagattcaaaccaatggctccccaactaacaatcagtgttattgggcatattacttagtctctaaaaccctcatttattccccctaaacgttgaaagggcaagaagaacagcacctatttcacaaaatattgagaggattaaaacagataaatcacgtacaatgctcagtagggtgcctggctcatattaagagcttactaacagtgaatctttgttattttgcttattgatattatggtagagcttgagctctcttagggagacattgtgtagtgacaagaaaagagagctgagggtaatgcacaaggcaaactaataggaaaaggtgcttttaagaggaaatgactattatcaacctgtgaccattttccattgtgtttactttgtgtgtgcttttatagctccttcttttactttccactgtctcctgacatactttcctaaagtcaaacaactatatattactattatttatttatttatttagaggcgaagtcttgctctgtcgcccaggctggagtgcagtggcgcgatctcggctcactacaaactccgcctcccaggttcaagtgattctcctgtctcaacctcctgagtagctgggactacaggtgcacgccaccacaccagctaattttttgtatttttagtagagacagggtttcaccatattagctaggatggtctcaatctcctgacctcgtgatccacccgctttggcctcccaaagtgctgggattacaggtgtgagccactatgcccagcctatattattattattttttgaagacagctctgtcacccaggctggagtgaagtggtgtaatctcagctcatggcaacctctgcctcccaggttcaagtgattctcatgcttcagccttcagagtagctgggattataggcatgtgccacaatgcctgactaattttttgtatttttagtagagatggggtttcaccacgttgcccaggctggtcttgaactcctgagctcaggcaatctgcctgcttcggcctcccaaagtgttgggattacaggtgtgagccaccacgcccagtgacattttctaatatttcagtagtagtaagtgacgtgaagattacaatctggaatttggaatgggactagggaaggaaagcacagtttccccaaaggttgaaagtgtgcagttgatatacaaaattcataggcttatagtttaacccaattctagaagaaaaaccacacacgcgcgcacacacacacacacacacagttgccctaacataattacatgaattattcctctatgattctggttatagagatttttgggaaaaagattatacagcttctcttggtaacccagttcagtctttaactagctagaacaaagctcaaaatgctacttaaaccagacagcaaaaagacaggaataacttcaaacaaagtctttgaacttgtcttaatccagatgtgaaactgaaaatttatttgagtcaagggagttagaaagccgattttcattgggatttaactgataaaatgataatcagaacagttctctttcatactgtaattaagtgactggctcaaccacaagaagtggaattttatggggaaaaaactccaataggttaatatttctgtttttttctcccttattcgtcatgatttgtacaaatttcattaaatatatttctgttacaagttaggagaaaaaattagaatattttacaagaaaggaagttttatttattttttccttaaaatagagcacccaagagcaaagttaaagagtgaaactcctggacttgaatcttgcttcttactcttatcagctgtgtgctccttaaagaccacccctgtctccttgtgcctcctcatacctataagatgaggataataatagtatttatcctcaaagactattgtgaagattaagcaaggtataaagagcttagcacagtgccccccatatgtaaggcttaaaaaatattagctattcatatttttaatattttgatgactattcttgttcactaatatagcaaatattgctgattagtcaatgcaacacattcattctctaccttctccttccttccacagaggctaggaaagctaaaatttctctctgtggctcccctgcagctaagctagaagtggccgtgtgatgcatttctgtctaataaggcatatatgtacataaagtatggtatttctagacataaaagatgtatatgttgataaccactcttcctcttcctatcttaaatatggcctggaattacggcagctatgactgctatcatatgttaccacctccttcttcctatcttgaataggcctggatctgtagcatccatcttatacttaggagtacagaccacaaggtcattcttttagttgctctggataaaacatacggcttgctggagcccaggaggcagaggttgcagtgagctgagatcacgcctcagcactatagcctgggtgacatagcaagaccctgtctcaaaaaaatcccatgaccaacaacaaaaaataaggctacattttcaaagtttaagtgaaaaatattttgcagctacattagaatgtgtaaaccataattagcatacaatttattacattgtatccaaatttgaatctaaataatttcatgtcttacactaaataggattatagagatgatatttatgaaataaaggattattattctacaaactctccagcttaaaaaaagaaacctattcttggatgtcatgaataaactatgattgaattttaactatatacacaaccaggaaaaatggtaatataaatatactataacaaattgtatcatattgttattaattcttaattttcacatttcttatgatttaggttctgttgtaagaaaataattccggataaaaaagctatttatctgctcacttaattgtctactcaaataaaaaagttacaatcatttttggaatataaacatattaaggcacaagatgtaagagtaaccatataatggatgaatttgtcattacaaaaataaggagatatatcacatttaaaaagaaaaaaaacttcagtacataagacagcatttcctaaagtgtgcaccacagaacactagtcctataagaagctctgtgtgtatgtgtttagggagagggggtagagaaggtggctctgtggtcaaataagtttggataataatgagcaacagaggctgggtgttgtggcttacgcctgtaatcccagcaacttgggagactgaggcaggaggatcacttgaacccaagagttcaagactagcctgggcaacatagtgagaccttgtctcttaaaaaaaaaatagccagtatggtggtgcatgcctgtagtcccagctactcaaggggtgacgtggggggatcactcgagcccaggaagttgaggctgcagtgacccgtagctgagccactgcactgcagcctgggtgacaaagtgagaccttgtctcaataacaataataataatgtgtaacatgtactacacttggtgattcatatcaaatacacatgacaagtcaattcatgataaaggtggcatttcaaatcagtagaagattaaaaaaatgtgttcaataactactgtggtagcattagcctatttggatctcaccttgttatttataccaaaataaattccaagtggatcaaacatttcaacattaaaagattaaagtgtaaaactatagcagagaatatggaaaagtatattttcagtagttctggaatgggaagatattcctaagaaaatccaaaagtaatataaatatctaaaaatcaaataggacaggtacagtggctcatgcctgtaccctcaggactttgtgaggccaaggagagagaatcacttgagcctaggaatttgaaaccagcctagacaacatagtgagactttgtttctattaaaaataataaaaaatcaaataataacaaactgtacacataaacaatgaaaggataagctggaaaaaatatttgaaacattggcattccctcggtctgattttcttaaaataaagaatgcttgtaactcagtaagaaacaccaagaaatgggcaattgctattcagggaacccatcttctatgatctgaatctttgtgttcccccccaaccccaaatttatatgttgaaatcctaattccaaggtgatgatattaggagaaagggctttgggaggtgatgagatcataagggcagagcctttgttaatgagattagtgcttttataaaagggattctagagagctgcctttgtcccttccacaatgtgaggacacagctagaaggttacaggccctcagtgaacactgaatctgctggcatcttgattttggattttccagcctccataactgtgataaataaacttctgttcttcataagctactcagtttatgatattttttatagcagactgaatggactaagacaccataacaaaaataaataaaccatgctttagatgtgatataatcctcaacctcattcataattaaagatattctaaatacatcaatgagagatcattttcatctaacagcatagcaacaatgaaaaattatgataaatcagtattggtgaagggttggggaagaggtcacttcacacatttgttgctgaaaaatataaaactaatgcaatcacttcggaatataatttagtaatttttattagaaataaaattgtggccatctgtggtggctcatgcctataatcctagcactttggaaggccaacgtgggtgaatcgcttgaggccaggagtttcagactagcctgggcaacacagtgagacctctcctctaaaaaatagcttttttaaaaagaaaaaagattgcacatatcacataataatttttctctgagaaaattattctacatgtataacttacatgtgtggaaaaacatgtaaaagggtgtctgttatattgttgttcattgtaacaggagactagaaacaaactaaatgtccatctacaagagattgactaaataaactatgacatccatataccagaatattttgtactgtcaaaaaatgaggcatatttaaattattgatatggaccatctccaaaatatagtaagtgaaataaaccaagtccttattttatcaatgaggacatcgaatgaagacctttctatgaccacttatggctattaactacagagccagcaatgggttttacgacttccagcagcttagcaattattccaccacatggtgctgaaaaaaggaactacttaatcatttttccagtggtaaatgattgttaaaatgtcttgcatgtaagtattcaagtaacccactctgatgagcttgttcactctgacctattctaaaattactaaagaaagcaaaatttagaaactggcattgactccctggcaaaaagaatgctaccacagtcgaccttgtgtgttatgtagggtctagggtgctgaacagatgccttcagttgcaaaagcacagaatgtcggcgggtgggggggaatgtatctatttaaatacatatgtagatgtgaagtgataatgacatttaacaaaatgtgactatcacacagagcgaacacccacgatcctttaatcacagagtaacccagggaggaaaaggttaattacatggcacagcacctccacttctgggtagaagtttcacttgtcacccacaagagcttcactttattctgagtgaagtttaacaagcttaagcttgacaaatgcttacttcgcattgaaaatatattaggatttgttttagatttgttttagtattttattagtgaagaattgacttttcaatggcttttttccttatgaagtttttgaataaagaatgaaatggtttcagataatgaaaatgcttaattcaataagaattaaaaaaagaaggggaaggagctagagaataatatcggtaatttcacaggaattttctttcaggagaagccaggataaatggacttgaggccacgaggagccagtgagtggtgcctggaacaccgtatgatgcccagaggagcccagcagtcatgctctgacagcagcatatggtgcgcactggaagaaggggaaaataaggtcaggaaggcagactgggagcttggattcgaggctgaagaactgccatcaaatgtttttgaaaggtgtgaaataatcaaaactgtactccatgatgattaaagctggcatagtgtgaaggtgtcaagcctgggtgactgggaaaatggtggtatcattaacccaaaatgagaacatgaaaatcaggttttatgtggaacacgacaagttaggttttagatgaattgattttgaggtactggcagaatattctgttttgttcaggaagtagttggaaatataaaactataaagtctattgtttaattcaattctacaaagatacactaaggactacgtgtcaggcactgaactagccccagcccttgttcccatgggacttaaatgtaagagcaagttcaacacataattaatgactacctgtatgacgaatgttacacaaaataaatcagggtgctatgaaattgcttaatactgaggcaatagaggtgaagagctatagctatggttgcctagtgatgattccaggggttattctttgatacctggatttttacttaaatttctgaagatatgttttatttgtaccttaaacacagaaccatatagatatcacagtaaactgtggaaacctgtgtattctcattttgagctttaagggttaaagcccatctcactgctgccaaccttgcacaaagtaatttttaccaggctcaagttctttgttcatttctaacataaactttgtgttcaaagtactataagtattcattacctttgtttcattttaaaggagaaatgcagatttattctgcccaaatataatgtccttccttattccttccacagtgagatgtagcatcccattagtattaaacacagaggaaattttaaaatcctattcagaataacagcaacattgttttgaaaaggaggaagtcagcaaggagaataaggcaaatctgaatgagtgaaaattggtgaagaaaaagaattgacatatgctttcagaagaaagcaagtatgagaaaaatgaaagaggagacaactgaactttcaatgaactcattaacaattgtaaaaaaactggaggcaaaaatgtgctacagtctcaagagaacaatgaaagactccctccccccgctccacaactataaaaagctgacaaaatgaatacacgagccccacagtaaaagctgatattaggtaactttgagaacaactttattttatttttatttatttatttttttgaaagagatgagtctgtctctgttgccctaggctggagagtgcagtggcacaatcatagctcgctataataatctcaaactcctgggctcaaaggatcctcctgctaaagcctcctgagtacctgagactataccatgcccaagtaattaaaaaaaattttgttttataaagacaggatctcactatattgctcaggatggtctcaaactcctggcctcatgcaatcctcccacctcagcctaccaaagtgttgggattacgggtgtgagccatcattcctggtcaagaacagttttatttaggaaacaagagatacataaaataaagaataaaaaatttaaatatgaattaagacacactaggaactatcactttgattgaatgcctatgtgctagagtctgtatggaacattttacctagattttctaatttaattctcactcccctctttcaaagtagctattatctaatccattttaaagttagggaacttggagctcaaaaaggtaaagtaaggtgcccaaagccctgccatagggtggtagcagaggggagatttgatatctttctgattctaaagctcattctttccactatagacttttattgagagaggtgttacatgaaaattgataactattcagatccttaggtttgctgacttatatttaaaggtgttttaggaaatgctttaaggcacaaagaggtagtagctttcagagcaggaaacaggagcaggcaagcacaagctcgtttccccaaattcgacgggagctttctcccagaatctgacaataagagagatgcaggtcattcacagatgctccttcctcagagagaaagaccagaaacactcctcctcctgagaccaggagtatctgaaaatattagaattacttcaatctgccatggcctcctgactcctcctttcaacctagccactggggattgctgtagttgggctaaaactttgaaggcagctaaaccaccatcaccatcattcttagacaacagtgtccttctgatctttatttcctccagcattattagcatgaacaatctctctactacctcaatttcttcaccatacactcctttcacctcgttctcttaattgaaaatgggctctacttggaaactggacagatgatctctgctcaccccttctggtagatgttgcttgttcccctcctatctcacgtgcttaaagtctgcagggcacaggtggaggacatgggaatgtctgctttctccttgatcaaagctgctatgtcaggctgtcacttttttttcctcatgtaaaaagcacccgcctttgagacacatgtcattcagttacactgctgccatccctctgggtcactgtcatctaatcacgcacaagtctaccctctcattcagaataaactgtcaattgagtcagtcttcctcatcaggccaggctctgccatcatcttgtgagaattcagtttaatgttaatatctaatccaacaccaggtcctaagagttccttgacctcctcctctccagggagcaatcccttctacttcccatcaccgacttccttggccataatcgaaatcttgtcactacccagagctgttttacttccaataacttgaattcatacaaccattttctgacccatgtccttttcctctctctcttttcctgtcatctacccatgaaaatctccaatgccctggcaccactgttttcatatccttgactatctagtttagactctgtggtgcatcactttgaccatggttcacacgctggtatcttacttccctccttcattctcctactttttcagactcccactaaaatgtaaataagccccaaactccatcttcttggcattactccagatgctgagtagtgccggtaagaaacaataccacaggatctgaactagtacatatgtgcaactgctacctcaattggattcttaatgctattcagcactcctctgtgtttcatcaggaggctctcccactccctgagagggtttacatgcttacacacttcactcaagcctcccaaccaaccatggcccttcctctgcaaaggccttccttttagatagaaaacaggaaccacttgatgaaagcttccttaacttcccaccatcaaacctacaaatgtatctgcacttaggcccaacatttcctcctttcaatctatcacaatggcagagcatgtggatttccaagacaatttcctctacctgtgctagtatcttgttgttctccacccctcctgccgccctcagaagtttactccattgattgtcattctcttccaattgccctcctttctcattcctcccagtctgcatttaaacaaattaaaacacctgctttgtcctcccctttgacttctaaatcccctgtagttactaccctttcttactcatatctcagtctcatctcccatattcattcattaactctttacgctattctttgagctaaagtcaatgggatggctgttagttcattacatgattctttagcagtatttgattgtgttgactacccattcctttttgaaatggtctcttccttgggcttcatgataccagactttcttggtcttcctactactttcatgtgactcccttgtcaaggtcctcttctgggatcttcttactctgctcattcttacaccattccttgaattttccattggtgttttattcattccatggcttcatttactgaaaactcccaagtttttatcaccagcaacaagcgctattcctgagttccaactagggtgaccaaccatcctgacttgcaagactaaggggtttcctggaacacaggactttcagtgataaaactgggagaattaggcaatctgggatgtgttggtcatactagccccttcctactcactagacatggtaacctggatgtcctagagatacctcaaatataatacagactgttcccaacttacaattttttgactttacaatcaagcaaagcaatacacattcaacagaaactgtacttgactacccatacaaccattgtctgtattcaataaattacatgagatattcaatacttgattacaaaataggttctgtgttatatgattttgcccagctgtaggctactataagtgttctggaatgttttaggtaggctaggctaagctatgatgtttggtaggtttaggtatattaaatgcagctttgacttaaaatatttccaaattatgatgggtttatctggacataaccccatcaaaagttgaggtgcatctgtatatacaaacttgaattaccattttccccaaacctctacctcttattgtgtcccttatctcagtgaatggcaccacctactcatgtcaaaacactatgagtcctttttaacaactgttgaaggtaaatataatagaaggatttctgtatccctaagcactgagtttccagttacatttcctattaggggaatattcaataggattcttatatagcctgtcagcaatttcaaatcttctttagtgaaaaaaaaaaaattaaaaaatgtatcattcatttgaaaagttacagatctgttggatagtgccagtggtgcaagatttttttcttcaatgccacatccttctactgtccaagttctgatgcgaattttgatcactatctaatccactataaatatcatttatttatttatttttatcgaggcagggtctcattgtgtggcccagactggtctcaaactcctggcctcaagagatcctcccacctcagcctcccaaagtgctgggattacaggaaccagctaccatgcccagcctagtataaatattcttctttaaacattttggaatatttctaacatgctgtttaggaatgattaattttccttcccaataagctgaaagaaagacatgttcctcaagcaatgaaactctggaaaacaatttgtattaacttgtgaatgcctcagtctgcaagacatagtacatgctttgtaggtcattaggaaacaaaatggttgtctttcatagttcattctgtaaatggcctgtgggccgcagttagctccacacatctcctcactctgtgtgggctccatcaaatattgcctttaaatttgcctggacaactgcacaaaggagaatgaacgaaagcttcagattaagaatgtacgagaagcacaagacgcaagactcttcaggccaaaggaagtaagacaaaaaagtgacttcatggtgctctgggttattatatttatatttcttcatcttcattcagcatgagacagtagataggctgataatataatgaaaaattaagactaaatttcaggaagaactatctgaaaagaaatcattattactatagggcctggccaccaaggaaaatggcatcctttcccttctcttgaatttaaggagatgcttctgtcccagggaatttaggtatatcattctctctctctttttttttttttttttgagatggagtctcgctctcccgcccaggctggagtgcagtggcgtgatctcagctcactgcgagctccgcctccgggttcacaccattctcctgcctcagcctcctgagtagctgggactacaggtggccgccaccattccaggctatttttttttatttttaatagacacagggtttcactgtgcgtgctaagatggtctcgatctcctgacctcgtgatccacctgcctcagcctcccaaagtgctgggattacaggcgtgaaacactgcgcctggccaggtatgtcattcttgaactgggtggcttgctatggtttcacaacttaaagtttgttactagacaaacagttacagacatattctccattgctcaatgtatttttctaagctcatgcttaccatttccacccgcttgccagccatcttgtgaccacatttgtacatattagtgctttcatcagggggtaagtgcatcaataagaggagaagttgaaattagattagttaatttgctacttcattaacagctgtggtaaaaagtccaaggagaaaaaagattgaaactagctaaaatgaggggtttgtattgtaagtgaatctaaattatctatgtcccctattcctgcggataactgagagtcagctgtgcacacatctgtgggtgtttataaacatttaccatctgtgagaagcttatggggcgtaaatggtgggctaattagtgaaatgctagtcatttctaatgacagttgttatggataaagattttatccaggttaaattgatctcagaacctcgatcacgggaggccactctaccttttatgacaagactaagtagttacactatgctgaacatgtcacacattaaggatgcaccataactagattagactgctagtttatgcatgttaatgagctctgttcttaatagactgaagtgtggattgagtatttgtcagggaaaatgagaagttgtcagtctgttgaaaggtcaaccatttctatagtaagacattttcatttctgttctacaaatatattaagtaccttccattcagaaaattaagagcatagacagaaaactatgagattcataaatgaaaagagttgtccatatacatacacacatatgtgcatacagatatatttccctaacttcaccatatcagtaactttttctaaacatatcttttactgatccatattgtgggcaaacattctaaacaggtaattttaaactaaattcatcctataaccaaaggggggaaaaaaaccatactgtataagaagagagtcatatttactgtgtaataaaaagtatcttaaagtagagattatgttgtaaaagaggacagtgtcatagaacaagtgagtggaagagtaggcaaaacttcattccttgggttctaataaagtttgttattaatttacagaatacaaatggaattttccaaattagaaggaatcttattgtgtagataaggagaattatggtctgaagctaactggcctgctattacttagctactggtggagcagggactggaatactgataacccaactcctaaaccttagcaccaaacatttcatgacaccactattaacagagaatagcaatattgtatataatgtcaatagttttagtaaatgaaaaaaaaacaccctatgtaaaatgtcactccttcccacactttctatccccccatccctactttattttgttctccttataagttgtggacttctaatgctgtttatttatcttaaatgttgtctgtctcctgccagaatatatgcccatgagggccgggacactcgcttgttttattttctgctgtacccctagtgcctaggatagtatcatgacataatatgcgataaataaatatttgctgaaagaaagttttgatagaaatactttttttcaccatcacactaataattctgctaatgaaggaagtatttcaatgcccatttttataatttcttttgtcagaaatttaatggtcacaaaagcaaatcacacaggagccttgggaatgtctttcagaatgttagataaggtgtaattagtacctaatgaaaaaacaataaccaaatactgactacaacaatatcacctgccagcaaaataaacgaatgcagacttcaataatgagaatcctagagccttggaactgaatgtttgggctagttttagatgaagaggaaggagtgggactgacctgttttccttcaaggggataatgggacacattctctccattgccctacctgaaccccatgcctcagattctccaggaaagggccacctccagcttatcctcatgagctaaacatggtttattttcagaggttctcggttaatctagctacaaaaacttgcaaagttgtctttattaacaaatttgtttttattttcctctatgaaagaagttaatagttactgtgcagatgttgtgtttcttaccctatgccaggcccattcaggtaaaaaacactcccaagattaaaaagcctttaaattggagatgtaaaatctatgtgttctaaagctggtaggagcagcatcacctacctgttcatgaagtattctccctgtctccccacacccaatccactagaaagccccattgattctgcctctaaactgcctttcaaatccatcctgtcttctcttttcagtgcatcctagttcaggtcttctacatttatctcttgcaaaattgcaagtgtcctaattagtctcattcctcctagtcccaacaccctctgatccatctgcgtttttgctacagagccatttctctaaaagcaaatcatatcactgctctgtttaatgcccttgaaatgtgcctacaaaataaagcaaaaaaaaaattcaaagcatagcatggtttcttgacttccaatttagcatcatttctgcccatagttctacccaaagatcaatcaggcctgctacattactggttagtccatatataaatgtcacacctctgtatctgaatttacttagcccattggatgcccaggcacagaaactctggcccttcatttcactgtgttcatttggtatccacctaattcaagattccacatttcaaaggaacaacaaaggtagtcttttccacatttactgctcagatgtcaatccatcctcctctctcccaccccaatgtgagagccaaaggatcattcttagtacaggaaccacccatgtagcagaaaatgcacaccacattcttaggctctgaacagaaaagatgcccccatctggtggaagagaaattggaagtgagattacatgcagtgcagtagccctgcgcattcatcccaggaggaagtggcgcatattgggtagactttcctaggaagttacagagagttgagtccaagagtggaggtgtcttgtgtccaacatgcagaattgttgagaatgggctaaggaaacaagattagggtacaagaaggctgcagaagcaccacaagaagctgagtgctgtggttgaagcacagtaatttcctatgcatcctgcctggggaagaaaaaaaaagttcactaagaaagagcacgagtgcaagagaagaatgtttccaagaatcattaacataaggaagccaaggagggaactaagagaaatccaattgttctatttggttaccattcaaaggcaaaccagtgatcacctttaccacaagcagacaggaggaatgatgccaaagcagggaggctgttatggacgtagatgccaactgaaccagaaagagggcatatgcacagaagggtggccgaagctggcttccttcatcgaaggaagaagggagataagaagagatcatggaagggaatttcaaacacaaataacaactctctactgaaattactggaaatatgcacacacacacacacacacacacacacacacacacacacacacacagaaggagaattgactacattgttaaccatcaggtaggctgatgactcagtcataaattaaactgcatttatagaaatagttatatctctgcatatctgaacttgctgtcctaactatgaaattccccgtttgttaccaaaagtataagagcacataaaacaaacttgacatatgtcatatcttgtcctaggattgtgccaatctattttatggggtctgcataaatagaacatgtacagttgaggagtttttgtcccacaaatgtgaattccataaatatttttaaagtgcttattaaacacctgctatggaaagaaattagaagcaacagctcactgtaaaagatatttttttgaacatggttaattttgattaaaggttttatttttgtaagatttattattgagaaataatggcatgtttgatctttatgaaaagcaaatttttcatagcaaaatcaaaatattaactgaagtatcatttaaaatgactatagtaaatgtttcatatcatgtccctcctttcttgtactttattaaagattaatattgagtatctaattaatgaaatgagataaacacttacttcaaaaagacttctttttgaagtttctaggaggaatacaccaaattgtcaaaacttctgtttcagaatcagctgacctcaaattggagcaggctaaaaacatgcacacaagtgcgtgtgtacacgtacacatgcatcctcccccatatagaaaccctcattactcattagttaagttgtaatatattcagatggaaaattttatctctaagcgttcctcagtttctaagaatggtaaacaccatgagatatattttccccttcttttcttacctttccctttttagaactgataaaagatgactgagttcatatcctacttatatcaaagtgcaatgctttaggaataggacagtatcaagcataaaatgggaattatctcatagggaagaggaagatgtgaaaaacaacactccttccgaagatttccccatcacatgagtgtagcaattctgaacaaagcttgacatcatttgggttcttctaatattttctgggcagagaagaacgtttctttaatttcccacaatgcctccaaatataacattaagacattttatgctcaatctcggcagatatcatgatttaggaaacagcatttcctcagactgcaatgctatttaccttaatgatagaatcaattagaatacagtataatccaaacgacatgtttcctcagaccaaattccttcagaatcccatggaacgggtctctgaaagtttgtctatgggtagtgggagcagaactagcatctttgctcaagtgtgaacggtatttccaacgatcataaacaatattttcatctaccaaagccaaaatcacagagtacaattaacagagtcacagcaaaatggtaaaataatctgttaaaatagttaatacatttattttttatctaataaaagtatcccatgcgttcaagaaataatgagtgactactatcaaaaggcactgtcctttttttgagagaagagcattagtgttccatatcaaaccataaaataaataataaaggataaaggttttaaaaaagtacttttattcacacgtgaatccagcagaaagtacaatctaattagccttgaaaacatccactgaaaatcagagatcataattgcaattcagcactaatagaatcattacttctgaaatatatctgaaatgcagcaaaaagactttttcttagttcttggcctttgaattaaaataatcttttgttccccaagcaaacaatcttcttgactttgtaacacttgaaggctactttgcagttaagttaaaaagaggaactgtcacacatttagaatcttcaaactaattgccacagaatcagtgttggaatgactttggagggaatctatccagtttcctaaagcagtgatcctttacacaacactcatgaaagctagtaatagaacctcagattcagcactaattttacaagagttcctgcctgaatagcactaatagtttaaaaataaacattcaaaggattctattgaactgaaattactgtcacttatacccattaatgataattattattggaagttctatgatggcaattcactctagtcaggcaatggtctccaagaattgcttgctctaaagacagtcagtcatctattttctgttactatgctagtctgtcatattcttcctgccttggggcattctagcctgtgttaaggctgccctcattgttaactctgttactatcatattgcttataattctcttgaaaaacattggatatctgaggaaggaagctatccaggaaacaatattttaaaatcctattacaaaataatgtctaatttcatctaaacactaatgcctatttataccatttacatgtaacatataaatattcaatttctttgcttaatttccccagtctgccctagggtatatttattcatcatcaaatgccaaatactactgagttgttttttttccccctctttgagataatcactttagactttgagcaaccttcacgaccaagttcaacaccaatgaatagatttccttcaactttaaggatttaatgtcagaatgacccaaaatacaaagaaaagagagaacctattaataaaaaaagaaaaacctggctccacctatgaccttttgacacactgatatttccatcttgaaagatatacaaacaatactatagaaatactggggtctataagctgggctaaaaggataagaagcacaatggttgtgctagatcggttgctgaaacaatcagcagcccagatgcttgctagcatttcaaaagttcaactgcatgactttccatttcaaattaatagatctaaaaatcacacaattctctgtagcaagaaatatgcctaaagattaagttttctctgacaattatcattaattttatcaatatatcaattttaattaatttacttatcaattattatttatttatcaatttataaatatatcaattttatcaaaataacaataactcattatttttcaacacagactggtcattttgcaaatgcatacttttggctataggaagacaaggaaaagttttttttttttacttcatggtttttttttaatctgtctcttaaaatcaaagaacagagtctatgacttattgatctatattattattattattattattatttttttttttttttttttttttttgagacagagtctcgctctgtcgcccaggccggactgcggactgcagtggcgcaatctcggctcactgcaagctccgcttcgcgggttcacgccattctcctgcctcagcctcccgagtagctgggactacaggcgcccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgcccagccgatctatattatgaatcagcaaaatttttctgtgaaggccagctaacaaatattttaggctttgtgggatatatggtttatgttgattagtggagacagctaaggagtattgaatgttacagacaaagaagatgcaatgctgtgattgagttctcaattataatacaataaatgtggctgacattatcaaagttacagagttttccacattgtgataagatcaaaagaactgattggtatgatttttttgccctagaatatgaacagggtgaaattatgaataagtgatgttaatataaagatttctttggtaaaattcttagaggtagaccatgctacaccttaaaaatttaaattattttgcctcaaataaagtttatgaaaattggcatttaatcttttattcccagagaagttaaacaacaaaaagtgaagttcagaatatagtaaataccatattataataatatgaaaaacattttgaaaatgattttaaaatattggatgagcaataaactaattagcatgaggatatgccacaaaaatgcttaacaagagtggcactgataaccctcaagaaagtttaaaaagaaagaaagaaaaagacaaaagaaaaaaataatcactttcaaattaagttatgttggaagtctgagaacctcctcttttctggggcttgttggaaggggacaaaggatggtgtgtgagccttgtatagctgcatggagaagacgcaaattagtgcacaaagtggttgaactctgaatgagttttcataatttaagctatgttattccagtgaaagagatgcctgcacataagtgaaaagctgcctagttaactgacagagagactcttggaaaaatttcccaccagacattgcttgctactatttatggaacagaatttcagtttcttaataccatcagaaggaaaaaattgttacatggtacagttggtggacgtggaagaatgtctcagggcacacattacaagtaaagcacacaaaatgtttgtgccactcctaaaacctactatattgcaaattctctggttccttaacttctattctgagtcaaacaatgaaagtactgaacacatttctacctccctcagaaaagttgacctctggcaactatgttgggtcagaactattcagaacattgaagaatccctcctttgactgtgacaatcgccccagaagttccaaacacaaagggaagaccacatggcttaaaaccactgattatgttaccaaagacatgactgaccctctcacacatttccagggaaaataattctcaatcttcctatataggtatagtctagtgacagttaccacaatcattttggtccctttttcctgtaccatggttaaatcatcagtggtaaaatataatagcacaatagttaaaaatatgacctcgtgagaagacttgagtactggcttcatggcttgttaaatctgtgatcatgtgcaagtaaattaaacttttcgacatataaaatagtctcatgagtttgttataagtattacatgtaataataaatataggctggcaaataatatgtgatcaataaatgccagcagtagtagtagcagttgttgttgttgttgttgttgttacaatgtctgttctataaatgatggagtaaagaaaagagaaatatatccaagccaatgcaattccatttgttctacccttctatatcgagaaattactaaaactattggcttatttatatgcaccaattgccaataacactaaaaaactgaaagcattactgcacaaaactagaatatgggcaattatggaaagtaatctaagttttatgatatctgtagaagacagggtaattgttaaagcttttatgaaagcaagtacaaacgttaattgcatatctgttgagattggcagagacattccgaagtagaatttatgtaatatgcatttcctctaaaatggaggcctaattgcttagttattctaaattgcagaatggaaaacaaaggagcagttttggccatgtgggtaaacaacagatttctaaaagctaattatctctttatttaatagactgaagttgcaccaaatgagacatttaagtctaataaataatagacaaattgtaacctaaagactaaaatataggagctgctcatacagtttttattgctccattaaataagctcttatttacttcccccacaaaacataattacacaacactgggtccatttcaaggccattttgatctgctatttaaaaatgatgtgaatcaacctacatactcaggaagtcttaaagcataatattgaattctgttagcaaatgccctatttgtgtccatgattaagaaacagaaatggaattaagaaaaagttgtgcataatcacataaaattattactactacttgccttactagaaatgattacacttaagaagagttatgcattttaaattaataaccactagggtctatgcttagtagttttcatgtcagatgaataggtactttttaaattaaaatagttcaaactcaagcatcaaccttagacatttactcaaaatttatatgttgattaaataaagacatcatgaaaatgtaacttgcttgtttatgtaataccaaaacattcaacagaaataaccaaaactgtgtatgtgaatatttaagagaccttcaggttcatcatttaaaaaaaaatgagaaaacaaaaacgaaaaacatcatgttttaacactataacatgaaaataggagactgctttcttagtttggttgctcagaaggatttttaatgcttcatttttcttcttggagaaatttagtccactatttttatctttattttcattctattaacaaaaatcacattctgaaatgatagtgatagtaaataatagtagatttggaaatagttgcctgttctcttgctgagggcaagtaatgatttactatgggtaagaaagaacaggaatttaatttactgtgctacctcagatagtgatacaagaatttctacacctgtgaaaaaattcagttcttatttgcatggagaaaatactaaagccatgaaaatatatggaaggaagctccctgtgggtttatggcagagttatgtgaagatttctctcttcctccatcatccaggggtatgtgccttacatatgaaaataagctaaaacaaaaagttcctggcccagtgaggtaacaaaacactaatgtaaattcaataattcacccttccacattcttttaaggctgagaaagtcgggctaaaaatttctacgaagatttgagcagtaccatgttctgtactaaaatataacacctgcgaagaaaaattacataaagtttcaactgatcctcacagtgtttaaaaaacacaccatattagcacatatagtacagcttataagcctggttatccaaaaaccacatacactaattatataaatcttaccaacttctgaggatttttattaaacaatatttaaactagaaagtttgatacatactaatagtctccttagttctctgagaccaaattttgttactaccaccagcctaagcagtctccatctcattatcctatcttattttagttcctgtaaattattatctgacattattttatatatttggttatttgaagcactcattagaattttaaacttcattacagcaggaacctttttattcttatttatcactgtaatctcaacatatagaaaaaaacttgatgaataaaagaacaataaaaagtggccttgctatatttcgttttttaccaataaaataataatagaaatgataacacatatttttataatagtacaatgtctttattgaagatcatatttgtcaaatatcatatgcataaaattcaatgtatcaatttaaaagtataaaaaactgatatttaacatattttcagtaattaagtgctaaattagatacactagtaacctctatttcataaaaccttcaaatgttataaaaatcatgacttgacaaaaagcatattctacatataatatggaaaaaagttgactgtattatttgtgatttttttaaaaatgaaaaaagttatcaataaataagcatgtagtaatatatttgttatatggttatatgactcacttggtaataagagttactgtaagaaatcaaatgctttgttcttctacattaataattgtgttgattttaaaggaaaactaaggaccatcatcatcatttattggggttttagaagaggtctttcactttggtgagaaaaatatgtgtttacaaatattatgaaatttgggctattatccctagattattttaaatcccacagtctgaaaaaaaaattcaaagttgacttgcaaaaatttcaaacgtttttaaaagacaaagtctcacagtagcttcttaaatcatagctgtttcagcatgttgtatcaaatgagttcgattacatctatagcaaattcatatgtatgatatagacatagcacatatctgtatttattttacagatatattactttaaacttacctattttaatatcatttatataaatctaagttactcagactatgctctgcagagggcacccctgaaaaatgttaaaatgtatgatgcatatgtacctcagcaaattacaggtttggaaagtcctattgggtgaagattttacatttacttgaggcccaccgatgttaatttgcagaccatgtttaggaagagatagtacagaaaaagtctaataaaataatccaataggtcaaataagatgagctctatgattaacgaaagatataataaaacgtttctttaaatctattgttaaaattaaaaacattcaagctttttttaaaattaagaaaagaaggtaatgtcatcaacataaaattacctattttaaagaaacataaaccagctattaaacacaattgatggctaaatattagaatgcttttggtaaaatttagaaacagatccttttatattaaaacctatatatcaaatatatgattaagggaagattataaataagtagagtacagtcatattataaataatcaaaactagaaaagaaatgaagttgatatgaaatcagtgaaaggatgattttctaaacttaaaggtgacagaaaaaaatcacaaaggcaaatattaaaacatcatagaatgaaaataaaagttttatatatatcaagatatagaaataaaaaagccacattagaaggaggtatttaaaatgtaaatatgaatacatactgagctaacttgtacaaatcaataagaaaaagataacaattcacaacagaggaactaaaaatgaacttataaacgctttttaaaagtccaactttagtaatactcaaagaaatgcaaattaagataataaaacataattttaaaatctataaaattagcaaaaatcttaaaaaataagaatattcaaccaaggcacaatcataacccaatgttgaaagttgagaaaattaaagttatgcttctgaaaatcagtttgtaagtatgcatcaaaagtcttaaaaatatccttttctattccatgtccaataaaataattacaaacattttctatttatggacaaaaagattaatcacattgaaaagtcagcaataactattgttccatgacttcattactgactaatgcaagttaaattgtatatggcacaaccagtggaatcaatcatatatatattaaaaattataagaattacaagctatgaataacatgaaacattcaaaagttcagcaacataaagtgagacactgaattgcatatttactaggatcatagctactattagaaggcagaaaaatttaaaactgaaagaacagtgtgcagaaatgtttacagtgattttttggataggaagattatgggtaacagccttttgatctactattttttaggtgttttcgataatgtaaataaatttgagaaataaacttattcttaaaagtgaaagcttccttagggagacataaatttaaattaaaacatcactgacattacattggaagttttattagaatttctttgccctatcaagtttcaatctttcaaattggtataagagagaattactgagacactctgtgtgatcagaccctgggcaaaacccacaaacaatacatccaatctgccatctagcaactcatctagataactatagacaacgctaaaagagctaatgttcaggctgggagcagtggctcacgcctgtaatcccagcactttgggaggctgaggtgggtgggtcacctgaggtcaggagttaaagaccagcctggccaacacggcgaaactcggtctctactaaaaatacaaaattagccgggcatggtggcgggcccctgtaatcccagccactcgggaggcttgaggcaggagaatccctcgaacccaggaggcagaagttgcagtgagccgagatcgcgccattgcactccagcctgggcaagaagagcgaaactccatctcaaaaaaaaaaaaaaaagctaatgttcaaacaccagaatcttctgtaaattaggaagtaatatattaatttaaaattctttccagaagcatattttaaaaataaatactaaatctttctgatctccatttttattcatacttaaaaataattctgagaatattccctgaatttcaaatataaacaagaaattgtgcttagatgatttttcttcccaggaagaaacaagtgcaatacattaaggtactcgtttcgctttagtaagcataaaaatatacctgtaaagtgaaagtaaagaaggcaaagtaggcatctctgtctattcctggggaaaccttaggtgaatttgcaaccctgaattgtaaactatggtgatttagcagtgaagcggatggattttaattaaagccttgttcaatccttactgacttggaagtagaaaagccaaatttttcagggaatgaaaatataactatattttacataattcttttgcttctaaataagtggtatcttttagcttcttgaaatacatatatacatatgtttctgtaaaatttcagtaccagtctctaaaagatactttgaaacatattgacaacaattttgtcatgtttacaagaaaaaaaaaagtatccaaaatgttcagactgcttttttctttttgttgtttttttgaaacaaaatctcactctgtctcccaggctggagtgcagtgtcaagatcaaggcatactgcagcctcaaccttccaggctcaggcgatcctcccacctcaacctcccgagtagctgggaccacagattggaatacacataaattccatacattacaattggctgatatgtcgcttaagtctctttcttttaaacaatgtttatcctccatcactttttttccctcccttgggatattttgttgaagaaaccgggttacatgtcctatagaattttccacagtccatttctgacagttactttattaactgacatacattattaaagattgattattgaggtagtaattaaagaaacgtgaatacgctggaacgaaaacagcataacagaggaccaaatcacctatgaccaacactggaatgaagacactacactactcgttagtaaatggaagggaaagaagaccataaagaaagaattgttctatggtttaattacagaaacaagtggttgtattttcctttttcactaagttcattaatatactaataaagcagcccatataaatcttaagtatacatagaataaataacaaatttgatagtactcaccagtcttcatttctaataaacgctttttcttttgttggcgttcgagtctttctcgctctgctaattctttagctattctgacacgtttttctttttcctctgcttctctttttttgatattctcctttattgcttgctaaaaaaattttgaaaaatgatcaattttaaccagtgattcatcccgcaaaatggaaagttatctatttgaaaatatgcttaaggtagaaacatgattatcttttagataatggtgagttatgttagtaatacagtcttctaaaaggtatgcacagaaacccttgttaactatgttatgtatctataaatacgactgttattaaacttaaacctgcatctttaaaacatccacatcttgatggaattaactacctaaaagggagatgggagacagaaactgaaaataaaaaaaaaactaattcacaaatcaaaactgttttctcatatacatttccaaaagtgtctagcaactgaattagggttttccacatcttctttgcaaagcaaattatcaagtacaagaaaaattatcaaattaaagacataataaaagaagtgaaatcttgtagtggctactttttattacaatcatatatgaatttttctaatatagagagaaatgtcgtaaaggtaactaaagaaatatttcttggccgggcacagtggctcacgcctgtaatcccagcactttgggaggccgaggtgggcggatcataaggtcagtagatcgagaccatcctggctaacgtggtgcaactctgtctctactaaaaatacaaaaattagctgggtgtggtggcgggtgcctgtaatcccagctactagggaggctgaggcaggagaatggtgtgaacccaggaggcagagcttgcagtgagccgagatcgcaccactgcactccagcctgggcgacagagcaagactctgtctcaaaaaaaaaaaaaaaaaaaaagaaatgtttgtcatttcaaagccaggtcctctggctttgatcaaaactaataataacatgctaatcataagaagatctcaatagatatgtgattatttgtttaatttcttatttcttaagtgttatacacatcaagaaatacctctcatgtggcattaaggggaattagcaggtaaacatgggatttttaagtgccaacaaagagagtaacattatattaaacaccaatgaaaccaaacaggttaacacattggacgtttatcaccactggtattaaatagaaaagtgtgtaattaaactataacaagtaggtggcttatgttgtttcgggagaaggcttttatatctttactgtggtattctttattttaaccctagagttagtacaagttcttcattaaaaatcaaataataaagtttaatatttttgaccaacaacaaaaagaaacaaaaagcacagagtagaggggacagtaactcatgcatgcatgcatccatccatccatccatccatccatccatccatccatccatccatccatccatctatccatcgatccatccatccttccatctatccaattaatacttactctgggactactaaatagtattgttgtaaagtaggggagaaaaaaaaagagagagaggaaaggaaggcggagaggggagaaggaagagtgcataagagagcacactaaaacaagtttacattctatatggtagggtgcggcaggaggcagagataaataataaataacaacaacaaaataagagtgccgtgatagcattcctgaggggttactttacattaggtagttagataaggtctcactctgacttgattcaagctgaatcttaaatgtcaaggagctaggtaagtgatgatctagaacacatcaggcagagggaagtgctaatgcaaaggttgctgttgggtttaggagacagaaggccagtataaaggtataagatgaggtcagggaggtatgctgaggcctgatccctcaggatcttctaggccaagacagggaggttagattttcttttaagcgttctggaaaatgactagagattttcaagcaagtgcaaaactacgtacactgagatacaagaaccaaccaagcacctttgtttcgaactatcttttcaaagatatttgcataatgaacagaagatagaggtagtatctccctcctaagctaaggggtttgttactgcccagaatgataaactggagcaaaggctggacagtcttactacctattataaaagactgcattccctaaattcaggatttccctccgatgacacaaaccactgtgtatataagtgtcacctgtccctttcctatagccctgtgggagtacgggcgcagaaacctaaaaaaaaaaaaaagtttaatctggctattgctattgtgtgagtagcaaaggattctttgtctctgaccccacatccatgaaatggtgtcaagttaacttgttagcctgttagtaggtaaactctcaaactcttcacagttcttgacatatataaacgctagttattattgctaagctataaaataccagctgcaatactagatactttaatgtgcaatccctttaattctcaaattggattctgcattctctaatctggcccagagtggttaagtacttgtttactgtaataaaagtagtaagaggcagtaagttgcaagatttgaaagctagctacagtcagtggttttccaccatattgcttcatattatggtcatgtatattaagaggcagctatgagacaaaagttgtaataaaaatcaacataagaggctgggcacggtggctcatgcctgtaatcccagcactttcggaggccaaggcgggtggatcatgaggtcaggagattgagaccatcctggccaacatggtgaaaccccgtctctactaaaaatacaaaaattagctgggtgtggtggcacacacctgtagtcctagctactcagaggctgaaacaggagaatcacttgaacctgggatgcaggcggcagaggtttcagtgagccgagatcacaccactgtactccagcctggcaacagagcaagactttgtctcaaaaaaaaaaaaaaaaaaattcaacataagaaaggtaggagaagataatcatgggttcaaagacaagtgagtatatctgtatgtgtgtgtgcatgtatactcatgtatgtatctataagggagatggggtaagaagataggttgtgatagagaaaggaaaagcaaatattcaggaatgaaaattctatttcttgcttgagagaaatgaacaagatgaacctacaataaataaataatatatcatgtagcttatttatgagtctaattaaggtataacattttctgatgtgaattttctactctaatgactgaatacatttaaatgtgagtacataataggcaatctgctatcagatataattgccacacccttttagcattcccatgggtaataaaaagtgaaaattacttttccaagacctataaaacaatgtttacatttagaaataaggtctaaaggagttcttaaacctattttgtttcatgaaaaatgcactattgattttcatttaaaagcctacttcatttaaaacataccatattctcatattgtaactattaggagaagaattttagctgaaaaaataccaatagagagcacagaaataggtgagtctgagactaatatccgagttcaaacagtaatttgagattttcttttattctaaatgttaagaagtaaaagtagcttaaaacagaaaaactgaataattaaatgagaacaacatttttctggatatgactgcctcttagtgacttccatcctaaatttgaattaagaaagaaaagttaagggttagccagatataaagacaattggctataagacattgattttttaaaaccatcatcttttcttgaccttgttttatatttagtcagctggcaaataaaccgcactgcctccaactactttcagctacactttgcctaaagaaattctttgagtgttacttgccagacagagtttggtgcaacccccttaccctccaagtggaatgataaccaccattctattctccatttctataagtctgacttttttatataccacacgtaagtgagatcatattatggtatttgtctctcagtgaatggcttatttcacttaatataatgtcttctggtttcatctatgttgttgcaaatgacagaatttccattttttcatttaagtctgaatagtattccattgtgtatatgaaccacattttaaaaatccattcattcattgttggaatcaacatttttgaacagtatgagttggagatccaattcacttttgcccatcctttctccaataatatgcaaagtcacttcttttggatttcaattagcacatgtgtgttgcttcattttatggctgttttagtccatttgatcaatataaccatgtctctaagaataatactctattttaattattaaggcttacatcttatttttcttacttaggaatgccttctgtatccttgggcctttgctcttccatctgtattttagaatagacttgttaagtttcattgaaaaggactataagcatttttaattgatatcttcacaattttgagtcttctgtgaacagcatgtggctttttattaacttggatctttaaaaaaagctttagaaaaaaactcattttctccattcaggtcttggacatttttgttagatttactctctatacatttcttttgctattgtaaatggtgccttcttcaaaaacaatgatttctattgttttgtaacatataaaaatgtaatttttactttttgtagagatgggggtcttgataatattgtctaagctggtcttgaaatcctgggttcaagtgatcctctcaccgtagcctcccaatgcgctgggattacagggatgagccaccacacccagcctaaaaaatgtaatttttatatatgctactgataatttttcttattatttctgatagttttcctataggatttgtttttgctattcatagagtgctataatgtcagcttgattttctcccttttcaatctttacattttcaactcctacttgtcttatcttgctatactgactaggagttagattctaagtattaggttaaagggtttcctttgactcctttcctactttggagtagggtggagggttaaattagttcatggttcttgttttgaaatctgaataggattttctgacttgactgagagaaatttcacaattttttttcccattagactcaatatagtgaattatatttatgaatattctaatattaagccatactttcacttctaggataaactcaatttggacaggaagaatttatctttttgaacatttagtcataaaatacatttttgtattccatttgtttgagataatcatttcattaaaatttggtaaaatgtatctgaaaaacttctaggccaagtatttatttcaaagattaaaagtcattaaaatcaaaattagttatagaactattcatgctttctatttcttttaaagtaatttcagtaagttatttttgtctaggaacttatccatttcatttaccttttccaatactatcctacaaatttttacagaaagctcctctctttttactattttctgtatctttagttatgttcctttttatatcctcaatattatttatcttctctttttcttgattaatctttttagcaatatatctaattaacttgtcttttcagaataacctcatttttgccttttatgtcactttttctttcatttaatctttcatatccctccttctggtttctctaggatcatataaatcctttttaaatttctgaagtcagatgtttttaagtctttctgataaaagttattttattgatacataatacatgtacatattttgggggtacatatgataatctgatacttttatataatgtgtaaagatcaaatcacggtaattggaatatccataaccttaaatatttatcttttatatatgtaggaacatttgacttattctcttaagcacatatggtataaatttataccatttttactgcatccagcaaagtctaatgtggggtattttcaatattgttcaggtataactgttttctatgatttcatctttgacatatgactttttaaatgtgtttttagaattttcaaactagaggttttaaaatttcatccttttaattttatttctaatttcatgtcattgtggtcaataaataaataaaactggcactgaaaaatgtattgagatttcatggtctctagtatgtaaccaattttataaaagttcaacttgtgcatgaaaaaatgtgtattctttaattatcgagtttgaattctatatacactaatcaaatcaagtctgttaattgtttaacgcttgtctttaatgatatttttctgcttatcagtaagttaaagaactttgttgacatttcctaacataatcctaaatctgtcaacttatcgatatagtttattaatttttacaatgtcattttggggctatgttattaggcacataccatttttaaattgttgtatctttcacgtgaattaagctttttgttgtcatgaagtaattaatgtcttgagtcaattgtacctattaacatagtttccctttcttctgattaatagttgccttgtatttcattaactgtcctgttacttcaaacatttctatatccatagggtaaagggaggtctcttataaacagcataaaaccagattttattttttatacgatattacagtcctttaaaaaatttattgtgatttataaaatgtttgtttccatctatttgtctagctttagttatgcctttatttttcctgattttttttggtgtatccttcttagtctatttctctcactacagtttagaatttatacttgatatttctatcctttcactggttatccttgtatttttattacacaaataaatttttagcaacttaacaagacctaaagttaattaatatctgtatctccctttctcccttgactaaaataaagaaaacccaaattctaaatctctctcactcaatttataaatttatgtaacattgttttattgtgtactttctttacatttgttttcatagtacctatggcttcctgtctctcaatctgttttttgttgcttctttaaatacaacctttagagcagaggctatcgaactataatccttagattgaccacgtattttgtaaacaaagttttactggtacatagccacagccgtttatttacatattggatatggctgcttttgcactgttacacgagagttgccacagagactgtattgcctgcaaacctgaaatatttactatctggctatttaagaaaaagttttccagtctctgaaaaaaaatcttttaacataaggatgttgatgaaaaacacttttgtttcctgtttatctacaaatagtagataattccacctgtgctctataaagatcttttgctggataccccaaattagaagaacatttatgtttgtgcatcacttaaagatctcactctcttcagccttccatttttgcaataagtaatctgtatctaattgttgttgctttgggggtcatatcttttctctctggctgcaattttttttttggctttagtgttctgcagcttcattatttatttgaagtgagtctcattttatttatctggctttgtataagttgtatttcctattctatggattgctgatctggaaaattctaagccaccattttgaatattgtctttcattctttttgagtctattcttctgggactttatacaagtggtaggccttgtcatcctgttctccatgtttcttaagaagtattttacacttctaattatactgtccccctggtttgcattctggacaatttatttagatgtattgtgcaaattcaccatttctttccttaagtgagcataacctgctctttaatccattgaatgttaaatttcaaccaccacacttccatttccatacattctatttgcttttttcaaaactgctcctttttagtattctcctgttactttttctctttttaaaaatttcatgttctatttccttaaatatttcatatattgttactaaatatctggggtcttggaggcctatatgtattactttttctgatcatttcaccaaacaatcccttgtttctttgtgtgtttggtggttaggattgagtgttcttacttaattgaacttaatttgtgagaatcttgaggacctaaattgtaactgtcctctggcacagatttgaatttgcttctgtaaatagccagggatcatttctaacctgaataactttaatttgcttttgtcacaggtttattgtaaacattttattcattgtattcaccaagttgtagtcttggttttcattcccagggcaggcctaactttcccctttgctcacctgtgcttattgttcaggtttcaacttcattctttctctttaaccacttttgccttggagatttccctaattttctcacaggacagccacgtttttaaaatagtttgttgtattttggtgggatggatttttaagagtccctagtaaatcgtattgtgataagcaaagtcctcaaaagtatattgttttatagggttgaacaacacagatatcttatttctaaaaaacgttcatataatgtagcagttctcatacagtatgtatttcgggggatactttatacatgtgtgtttcatgacccaaaggttgcaaacaaacaaacaaaaaaagggtaattggacagccatatcaaatgagtcctgaacaagcactcaaaaaaatactgtggaactgaagatcaagaatgccttcaagaatacattaagtatgacatttcatcacttttagaagttgtaaaaaaaaaaaaatcaatctgagcttattgctgcatattataaagacagtataataagagggtagaaattgaaatcatattgtttggtttaaataaccacctagcactaaatagctgtgtgactatgcctcagtttcctctactgtaacatggacaaaatagtgcctgcaatacaaggatattttaagaaataaatgaaataatgcatgtaaatagcttatatcattgcctcacacataaattttagccctatataaatgttaacaagtattattatttctttacaataacatcaacaattttttattattacagtaccattaatgaagtgcctcaaacacatttatccagcaacaattcaagaaaaaaacatatgctggcttatatcaattatatatgcttccatcaaacatatgggggagtgccaattttcatagttcctataagaatatgaatgctttctattcagagatattggaatacgatggtacactgagctgatcaggagtaaaatggttgcatccaatacaagctgcatcacttggcaggaaagctatagtggtaaattaaatatggaaggcaagatgtagttctcaacctcaagtctagctattatacctctgaagatttaatttacatatatatgcacattgtttttaatattctaaatctaatgttcattatgagatttcattctggaaaaaaagagttagctttcctgtgttttctccacgaaagtactactttcacttgaaattagatattcctaaaaaattaacttaaaacactgcccaataatgcaattaacatttgttttatatttttccctaaaagtgcaatttaaaaaatcaatgtgcattttcccctccttctaaaaaaagcattataaacagcctatattccaaataggcctttacttgacaggtatatcagtcttattttatgttataaaataaaattttaataaaacaaaatataaaaatgatagcattaaatactatttagtgttataatagtattaaatactatttaatgttataatagtattaaatactatttaatactatttatttaactattaaagtaggctgccatagattctgactttttgatcgtacttcatctctatttcagtctcagcccatttaaacagattcgcccacccaactcaacatttttcaacatattataatatcctgtatatttttgcgacatagaaaactaggagatttaatcatttgaaaaaaagttgaaaagcttatgaatgtcttcttgttcagagttctatttcattcaacattaatggatactcaagcaatacaagtcagggatctctttaacacaggtttcactaaactcaaaaatctttactttttcctaagtattcaactttgtctcaagtccctaaaatgagattagattagacaaacctaacttaagtctccatgttttccaggggaatgacagttaggtactatgaaaacaagactaattttctcagagtaaacaagctcatgcaggtctcacacattcccactaaacaccttgcttagggttgtttaaccttaataaaaggcaatgcttcaccatacttaattactactttctagaaactcctgatgacttcagctttaggaataattggaaaacattttaatttggaaaaaatccttaaaaatacatttctgtattctcatacatattcctgtagtggaacaggaaaaaaaatttaaaaaattaatactagtcaccaaagtctgtcagaatatagaaattacgtgatctacttttcagttttccattaaaattattttctttggtaactaaatgtaaaaatgtaaaaattttccccaagtgccaaaaacaaacttattatagctactttgtggaaagtaagtttattgtaataattacaagacagatgttttagaaagaaatctagaatgacagtaaaattaatcaaaataatttttctagtattaccaaatccaattaaaaaactgttatcaatgaaaataggagaacatgatatactgtgctctggcacaaacaattcatcatcttaacattcaatatgcgttgctattagttgaactttttatgaccgtgaaacttatgaaaatgggaaactatcctttgaggaacaaactagaatatcccaaaggatgtgcaggtgctgattattaaactatttcagcttaagttgctatttgttgtaaaatcggtctcaggtaaaacaacaaattacttattaacccatcagggatgtaacattactggcccttcttaactttgctatgagtttctttgcaatctcttccacaattcgtaaaattttcaagtaaatgagatacttcaacctattcacatttctttaatagataaagtataagatgtttgtaataaagtttttcccaaagtataatttgatttcccattgtgtgttctcttcccttttgttcagaagtgatatataataaaaatattatttttatctcccaattacaaagctaaatacaagcacaagtcgctatgcacaagatggcagccatagtgtgcttaaaggtaggcttgctgataaggcagcagttttttgagttgctgctaaacacatattcaagggaaacatccaactaaagtcccactagtctcatatgaacctaatttatttatttatttatttatttttttttgtgagacggagtctcgctctgtcaccaggctagagtgcagtggtgcgatctcggctcactgcaacctccgcctcctgggttcaagcgattcccctgcctcagcctcccaagtagctgggactacaggtgtgcaccaacatgcctggctaatttttttttgtattttagtagaggcagggtttcaccatgttgtgcaggatggtctcaatctcctgacctcgtgatccacccactcggcctcccaaagtgctgggattacaggcctgagccaccaggcctagccatatgaacctaattatgtttaaaatgtaacataaaaaatagccttaagttaacatgtatcctctccttctatctctctgtttcctcttgtctctatgtgagggtgtatgagaataatctagaaaaggccactgcatttgatgtacaaagaacataccattttattcatttttttttgtggtattctaggttgtcacctttttaattacatgagttaatatatcttattattatgtattagttattaagttgatttcttttccctatattatcaatctatttttattctcactaccgtattagaataatctaggcattaccttttgctacgttatttcagggaacaaacaaaatactgaaaatgtggaaaagaaataaaaattagcagttattagcagtcatacagaacctggcagtcaaatccagttattatcccatttagcaatgcatagtacgaataaatcttaccaagaaagaaaagtaagccaattagtaaaggtctgtttttactgtgaagaacttaaagagtaaagactaggagaacctatcagaattaaattatttttcaaagttgcaaactcaaaatattcagcacctgaaattgatctaattccttaaataaacaaatactaaaggataataagaaaaacagtcttatagttagcatatttattttgttctaggtttgtggcatttagctccaagtttgatctcagaataacaaatgtgctaatgaagacataagtcttatgtgaaaagactccaaatacaattttcaagttgtaagcccaccaaattaagcaaggatagaagatgcttcctattaaaattgcaaaagctggctcaacactcgaccataggacttgtacatgattttccttcctctaacacatataatgagtcaatctacaagatttaggagcacacaggaaatgcttagtgttttgacattccttttgatgatctagttggtccacacagtagtcagcacaaatggcatttagagttgacaaggatcaaatttgtgtaatctaaatgatttggcaaaatgagttttgttctggctgtcctccctatcaaaaacaattttacactaaaaataccctctgactggatgatttcatttttgtttggcacttcactactttagtcggagaattcagtagaataataaattatatttgatcaacagatgcagcaagattaactgagttaaaattgattttatatttgttcacaacatagatttcaattttataaaccaaaaattgacttaaagtcggcaaacagcacaaatgacaaatctttatctagatgaaacataaatttaacaaaattgtagaaatactctaaagccagagctatacatgtgaaacaggtagctatttatttatttcacagtattctatatgggagcataaaaataaaaaaggataaaatacagtatcaatcctattataatgagattgaaaatgtaaaattactgtacttctattatttgtacatggctaacttgttttgagggtatatgtatgttatgtaatttgattttcaaaaagtaacatccctaagagatgcaggctgttattatcagaaaactgaggctcagtaaggttaagtaatttgcctatacacgtatcactaataatctacagagaccggactcaactccaagatgctctgatgccagaacttgcatctcaactactgctgtcttcccactagaacggcaaacagcaaaacatcactattaataacaaatgaattggctgaggcctatcataggcaggtttcatcaatcacttaagatttgaagaaatcaggactaatcatgtctctctttgagggtcatcacaggcaattaagatgggagatatatataggaaattaagttacgggagaaagagactggattttatgaactagaaaataataactacaaagtttggcacatatgtctatacccatctacaaaaaagagaacaccaatataatgcttctccactttttgtgtgcaataataatcttttttaaggcagggatttttttgttgccctctaaatcttaacctcaaagtgggatttccagatattcaaggtcttagaaactatgagtaagaaagaagtgtagtggcctttttcagtactttaaaatcccatcgggaaatgttcgtgtgctcaaaaataagtcacagaaataaaaatgtattctatatgagaacaggtgatattgcaaactcagagagtccacataacagctacatatgtctaactaaaacagaaaaatgacacatttattttatttattattattatactttaagttttagggtacatgtgcacaatgtgcaggttagttacatatgtatacatgtgccatgctggtgtgctgcacccattaactcgtcatttagcattaggtatatctcctaatgctatccctcccctctccccctaccccacaacagtccccagagtgtgatgctccccttcctgtgtccatgtgttctcattgttcaattcccacctacgagtgagaacatatggtgtttggttttttgtccttgcgatagtttactgagaatatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgtacaataaacatatgggtgcatgtgtctttacagcagcatgatttatagtcctttgggtatatacccagtaatgggatggctgggtcaaatggtatttctagttctagatccctgaggaatcgccacactgacttccacaatggttgaactagtttacagtcctaccaacagtgtaaaagtgttcttatttctccacatcctccccagcaccttttgtttcctgactttttaataattgccattctaactggtgtgagatggtatctcattgtggttttgatttgcatttctctgatggccagtgatgatgagcattttttcatgtgtcttttggctgcataaatgtcttcttttcagaagtgtctgttcatatccttcaaggctggttcaatatatgcaaatcaataaatgtaatccagcatataaacaaaaccaaagacaaaaaccacatgattatctcaatagatgcagaaaaggcctttgacaaaattcaacaaccttcatgctaaaaactctcaataaattaggtattgatgggacatatctcaaaataataagagttatctaggacaaacccacagccaatatcatactgaatgggaataaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcaacccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatgcctaggaatccagcttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacaaaattggaaaaaactactttaaagttcatatggaaccaaaaaagagcccgcatcgccaagtcaatcctaagccaaaagaacaaagctggaggcatcacgctacctgacttcaaactacactacaaggctacagtaaccaaaacagcatggtactggtaccaaaacagagatatagatcaatggaacagaacacagccctcagaaataacgccgcatatctacaactatctgatctttgacaaacctgacaaaaacaagcaatggggaaaggattccctatttaataaatggtgctgggaaaactggctagccatatggagaaagctgaaactggatcccttccttacaccttatacaaaaattaattcaagatggaataaagacttaaacgttagacctaaaaccataaaaaccctagaagaaaacctaggcattaccattcacgacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgagagaaaattttcgcaacctactcatctgacaaagggctaatatccagaatctacaatgaactcaaacaaatttacaaggaaaaaacaaacaaccccatcaaaaactgggcgaaggataaaaatgacacatttttaataagtataatttggtagaaaaattattttgaaatagattacccgtaaggagttctgcaacaaaggggtgtgaagaggatgaaagcattaggaagaatttctttaagatgaaatgttaagcaaaacaagtaagatgtcagatgaaatttgcttaaggagataagagtgttgtactttgctaataattttggataaggaaagagaatagtaaaagaactttcagcaaagttgggctaatggattaattagtacaggcttccacccgtaccaattaggagaagcatcacctggataacagagcattaaagaagagaccatgtagtttgggttatgtgagaaaaagcaattagatcaaaatcctctaatatgaatggaaagtgggaaccgtacatacattatgcttcaaagccacagtgaccaatgaaaggcagaaaaattaggtttaaactcaatggacaaacatgaacacgctacagctgttggatagattaaggaggatgaggttgctcacaagatccaacaaaaattccatgagctcaattaatcctgtagaagcatgatatcatttgctaataacaaatagattggttaatagcatgcagtgaatctaaaaccagtcacaaatagaaaacaatgattaatgctatacaacactacatgaataaaggtatgaacttcacttggtataaagcttgatgcccgatacgccaccgatttactcagcatatagtatgaggtcagatatttccacctagtacctccaatctgaacttttgtcttcactcaagtcttacagtaagtaaaaatctattacgaaaagatgctgaccctctatccttcaccttatccttcaccccagcaaccaggctttacattaatagtcctctaattttaaaagaacacatttcatgttttgaaatagaagcagatctgaaaacattcttctatcatgaacccatcaatgtaaatagacaattattatacccaaggagtatgaaaagaaagtatgccctgtgctgattctctctagtaagttatcaaaaacactcttaaaaattacaaccttggcttttcttgcaaactctctgagcagcaatgtacctgaagctgttaaagaacaggccttggagtcaggcaggcttccattcagtcttagccctaccaactctgaagcttctctgcaaagacatggagcttctctaccctgcagttatctcacctgtcacattctggacctcaaaaaaaaaaaaaaaacactgaaagacgaggtgggacactccatgcaaagcactgggcactggatctagtaagaagtaacttcaaaccatgacagttgttttggttttgttctgttgatcatggtaacaaaaataaagctaaagaaaattacaatgcaaacttactccctatttcttgggaaactgatcagtagttcaaaatagaaccattcccaatgagcacattatctacagtcgattgtttaaaaaaaaaattaattcccagttgagaattctcaagtagaagagaagtgagttaaactgctgtcaaaataaacagctgttcctcagagaagctacaagattttgaaacttttcccccttgttctacatggcttgaggcagcagtctggaacagatattccttctttagctattgtaacaaggctctcatagagcaaacaaaaaaatgaactcgaagggctgtatctatacatattagtcgtgagattctagaaacactgaggagagactgtatgagttagtcaaaggtatagcaaaaagcttttaaacccagcctttaactacttaagtttaaatcccaagacaatcttaaactatacatattttagatcaattatttacaaaccaaacgattgttccaaaaaaatggccactttttcttttcttctattgggagaggggttaggtttcaagctagtcccgtttgacacagcaatagcagttatgcatttaatagatgttaacgcaggtcagccacatatggtatagactgtggagccagacagcctggaaagaatcttagctccttggcagctatgtaatgataggcaagtcaggatctctctatacctgtttcctcatctgaaaaatgggaataataacagtacacataccacatttagttgctactataaggattaaatgggtaaatatagctccagacgcatggttagctctatatatgttagctattaaatcacccattgatcatctgttactcaacaaatttatctattatatgccatgaattgcactagagacagaaagataaatatgacagacacagatcttactaaaggaagaaatgtctgaacagagattagagggatgagtatgataatttagccaggcagagtatggagaaagtgctccaaacataggaaacagtaagtacagtggtctgaacttgagagaaaacattgcatggaaaactgccaatgggggagtaggtatggagtgaagacagtggttccaacccctgatatgtaatacaaaaattagccttcactttatgataaaagctcattcatgaccagaagtatacctaaatgccagtggatgaataaacaatggaaacattttaacagtactttttaagaagaaaatttttgtctattaatggggatttccagaacaagatcttcaacaaataaaactctacatctttctttagctacatatctaagatttccgtagtgactcattcacattaacctgattttcaaagttgaataatacggaattaaagagcaacctaagagatcagaagaccctgacaaaacgagacatttatttgtcaggagtttttgccaatattgctactctggacttcaaagcgatatattttgtctaaaatttaaacaatataaccatatttaccccccaaaaagaaagaaaaatagaagagaataaagtacctgtataaaatctcacaaccttgttacaatcacttcccttccagccttcatgcttatttttctcctaaataaaatttcttctatatactattctttagatttaatacattttaatatttaatgttaacaattttaatttagtgcagtgtacacatgaatgtgtgtgtggtggtagtgacttctaggaccccatgagaactctgaaacaaagtagagctgtcactctgttacccactttttggaacccttttcccattcaaacactttctctctctgcccactatttgcccacatgaaatgccaagttacccacagaatgccaaaaccctctaatccttttagatctatttacctctattatatgcataactgctactgctgtgtccaacaggactagcttgaaacctaacccctctcccaatagaaaaaaagaaaaagtggtcattttttggaacaataatttggtttgtaaataattgatctaaaatatgtatactttacatagttgggatctggattcaaatcccaactggatcacttacaaacaatatggcattgatctcatttggaaaccctccaaacgtcagtattctaatttgtgaaatggaacacaaactgtagaatacaagaggcagcatgacataatgtttaagagttagggcccttaaagaaggctttagagaagattatatgggtttaaattctagttcgaccattttatagcagtataacactgagctggatatgttccttctctgtgcctcagcttctttatctgccatagaagaactgtgtggcttgtctgacatactatatgtaaggcatttagaagaatgcctggcttatagaaaatacttagaatagaaggatattattacttcatatatccattttatacttgatgcataattgtgtcagaggtccccaagacaccctcatgtttgataatttgccggaagggctcatagaactcagaaaagccattatattcactgtgatggtttattacaaacactattaaaaggaaaaatgtgcaaagggcagtcttcaggagaaaccagatccaagtttcccattgccctctctcagtggagtccaacagacaatgcttcatcatccccaaaacaatatgtgacaacatgtacaaagtattgcaaacctgggaagcttctgtgagtcttggtgtcaaagattttattgagagtcagtcactttagcatagactgcctggaagactaattttagctattctatctccagctcagtaagaggtcaaatggagacagtgtggcccagggccccaggtagacaaaacaggtgttcaacataaatcacatcattagcatatctatataggttggcccaaggccccaggtatataaaacgcccttatcaggcaggatatttctaggtctcttagtagccagtcaggggccagtgttctttggaatatgaaggttttgagcaccccaagcctgctgaattaaccctttactgtataataatttattgagcaactaccatgtgccaggagctatgataaacattaaatatatattatctcatttaatactgaaaacatttttatggggaaggaattcacattacttttttaaaaccaatgtggaaactgaggctcaaggttaaacaagtcttcagacacataactcgtatgaaattcaaatctagctctctcagactgcaaagtctttactatttccactaagccatattgctttacaaaacattacaaaatttaaaataatatattgcaaagtatgtgacacatacaggtatatcatatttattaaccaaattcatttctggcaatgaaaaataatttacagaattgctttgaatttgtggagaaaataaattagaactgtgaccaaatgtgtatttttcctgtaaattagttttcctttaaaaatagtgtttttattaaaaggctatctaatcctaactaaataattataaccaagtccaacaacctcagcaataaagttttcctgagattaaaaagaaccagttctttaaattcaaccttctttttcttcacacctcaaaactttttaatcgccacaaacaattgctaaaatacagaaatgacttacccatctattaagaataacaatttttcattgtagaaatatgtcaccagtttccctagggaggcaacaatgccttctcactttaatatgtgtgtagttcttttcttccccccacctaatcagctaatatgtttgaaaagatatttttaatgcctaaatgaaaggattccacatcaaagacctgacctccctattaaagtatcctaaaggaaaccctacgaatgtaaaacctattcaaaggcaaattgcgtgtagcttattgtacaatgcattaaggaaaaaaagccttacaaaagctgcaaggaatttggtaaaattatatcacaaaaatataaactgatcttgaagtataaagaaacaaattcatagccaaaaacttattacagaagtgctctgtaattagccagcaagggagtctttatgaagaacttcagaatttgtcactttttcaatcaaaatgtctgattacagcttaatgttggaaaggccaaaaggagaacaaaccatacatttttcaatagatttttaaatctgaaattttatagctttcaaaatcagaaaagataggttttcctacagcaacaagagtagaacgatgtaatgagataatagataagatagtataaataaaaaaactttttaaaaaacaatttttttaccataccatgaatgtggttctgaagttattcaggtcagtaagaaagtcttccacagacaccttcttcacatcaatggcatagtatcctattatactctggtataacttttccatgttttcgtgtaacttcgaaagtgtctcatattgttcttttgcactgataacaaatctgtatactatagttaaggtattctgaaatttacaaagtaatgctttgggggcagggggaactctgtaaatccaatgttttagtctaatagccaccattactatatttccaaaattctaaaattacttctaatagttgaccattcttaaagtcagtctatactacatagcaacaaaatcttaaattcaatttccaattaactttgggaaatcattagaaaagatttatatatttaatatttctctttaacaagtttaaaaaatctttcttccaacttactataataatataatatgcagatcatacaatatgatttaaaattatagttcagtagttgcagctgaataattgcaatgatattgaaatcaacagtacaagcattaaacacaacagttaaattggacatcttgggatcaatttctagctcctatacttggtaatagtgtgcctgtgggcaagtgccttcatgtctctgtgcttcaatttcctcatctgtaaaatgggaacaataatatcaccaactcacagggctattgagaggactaaatgagctaacacatgcaaagttctcagaaaagtgggcatttagtagcacacaaaaatacttgttatcatcatccctcacttattttaaactttaaggttctaaaagcaaacaaaattttaagagttaaactgaaaacttctcccattatctaaccaaattagtgttccaacttctcttagaaaactggtatataatttctttatgcattagattattaaaaattatgattacacacacaggcacacacatatagaaacgttcttctctcactcatgacaatatatttcaaaacacactgaaattaagaagatgaatttaatgtgaatgtgacagccactgacattagaaaacattttctaaataaacaatgaaattttttttcttgtgtggcaaattgctaatgcagtcagatataacatcactataccatatccagaaaaaatgattcttttagagcatcactcataattgcctatggctcctttaaattaacatttaacgaaatggaacatagttaaatttgcagaagtccttttactaactttgactagccattagcaaaatttaaaacaaataaaaaacagtattcaggcaggccaagagaaagaagctaaaaatggaatttttatatctaaaatttttttggcccacaatttcaaaaagatatggttcttctggccagaacttacatcagtagaggatgaaataaggaaactgatgcaggtccttttctttgagaaaaataatgaaagaccaaggaaaaaagagacagcactactgccaggtagggagtaaatgtaggctagcatatgaaagaattctaattcttcatcatcatcttcatctaaaagaaaatgcaaatgtagttagctgtccttgtgcaaactgttaaactccaacttctgtattcgtcaagagctttggaaaaatacgtgagatactcaacaaaataaacatttcataaaattcattataaaaatattgatataagcccaattacttgatgttttgggaaatctattttgttttcctttaccaacactgaggccaaattctcatgaatttctactagaatcactgtcatcttcccatttgagaggtagataacaaccagatctgtgtttacatgcattgaaccacaagtgttaagtgttggccagctatgacttggaattctactcctggtatgccagtattgctcattaccaaaccacctaccacaaatatatcccacatttatttttaggtcatactgcctttattacagttctgtcactgaggatgcccataacttccattaacatactttataaggatcagcatcattcagtcctatgtgtctaatatatttcatagactttcttaagtacacaggatccagcaagccattcagtaagtattatctgagttccactgtattctaggcactaggaaaaacagtagctaacaagtcaggcaaagtccttgctgtcaagaaacattttagagtatggagacagataataaacaaatgaatcagatttttaacatagtaataagtatgatgtagaaaaaaaatatgatattacgtagagtgacagaggttaggtagttaaaatcttggctaagaaagtgagattgactaaaacaacagaggcttgactgttaaagagcagtgagctgtccattgggtagtactcccttgtaggtataagacttcagaaaatgaaaagattattataaatttggggactcagagagaattaagaacagcacatttaatgctagttttaaaagtctgctaagaaggaattaagtggaacacaggcaagaaagaaagaacagaagaagaaaaggagaagaaagtgagaagactaattcaagagaagaaaaatctgctacaataaatcacccaattgccccacttcccactcttacaactgggccgtgtattatacaagtttacatttcatccattccaatcttctattttacttcctagtcgccacagttcaaagttcaacatactaaattcctttatctgaaaaatgctgtacattatgcagtgtagaatatagatataagtaaatctttctctcaatgaatttactgggctggctttagcatctacccagtgatttcagaagtttctaaagcattgctatatagaataacacacaaaaaaagtgtgaaaataaagtgggatttcaatgaacaaatttaaagaatataacatggaaaggagtcaagtaacttgtcacataagttgtaataaatacagaaatatataaatgtctagcaaaataagtttttctgaaagactcaggagagggagtaggaagaaaatagaaaggcaagtgctcaggcaagaagaatttcaagtgcaatgctccaaattctatttgttcttctccttaaaataagacatatcacagaatttaaagatcatgagaaaggaacaagcactacatgacacaaatcctggcatattcttaattttctcaccgataaaaatttagtaagtacgtacacctcacatataatagcttgcatgtaacaatactgatatacattgaatttggtttcacatttttcaagcaagtagttactgtggaaatattcaattctaattaaggctctgactagacttagcaagtgggaggtaataattattactaaaatgtcaatgatatttgaaataatagtgcatcctttttaaaggatgcactaaattcaattttttaatattaagcagtatatgtaaagagtaagcatacacagaaagaataaaaatacaacatactatcatcgagtgctattagtaaaatttcacattacaataaaattgtatcttaataatttaaaacaattcaattaattgatttaacagttcactaaattataattatttaagtacgtacttgtaagatacattgttaacaaatttaaaaatacacatattcttccagaattggtgaatgaaccaaacatttgatatgtacctcgatgaataagcatttcaatgaaaaacatgaacaaagtttaagtggttaataacaaactttaagtatattttattcattgtgcattttagcttccaaattcttcaattttttaacatctaagaagctcacaatttgccattttaataagatctgtataaatgcatttaatatgcaaaatctgacatgtcagtcctaattaatgtaaacaaagactcgcaatgaatgaatttaattacttcgaaactagtatgtctaactaagatgaaaagcaaacgagtgcaatctaatctcagcaaagaatatttatgattataagctttgtcaatagcaaagtgcaccaactgttcatatatctgacttccaagagatacatgaatgctaatcagttcattagaggcttctaggttgtgatatttaatgacaggatgtagtagctttcttgtccatggagtataattgtactcagaatgaaaaattgtttccaacaaagcatcatccttcctgtttctgatttcctgctggttgctttttatgagccgcatacctttcaagaagccgacatcattcagtttcttgtgtcatataaatccaagtatagatatgtcctgagatcgtgtgctaagcaagattctacaacctttactccaagctcaggaattcatcttggttctataaacctgagcttcataattagtgcattcacagtgtactaccagaagctacatgcaagcaaaatcttttctgaactgctttatatctatagggaacaataataagtagttcaattaacagtacttagttattaacaaactgtcacatatgaatattttaacatgataaaattaagaaaaaagctaagaatgatgaaacatataactgcaataatatatttattttagaaagcacactttgtcatatgagaaggtagtacaaaaaaatttttgatgaatacagatttcacctttacttaaaaagaaaaaaaaaaaaaaagccttactcagtagggtgataaaggcatcctccctaatgaaataagaaactggatgggtggcaagatacaaaaggaaacaaacacgttagcctgaattgattgttgctggagtatatttttatgatatttcccgacagagacagtgaaggaagctaaaactcaactagttcacaattaagctgaaagcatatacaataaaatctatgacaagccaaatattaattttgtgattcactaaatctcaggagagaagaggtagaaagaggaaaaatagtcattttatttcaagtacctcagtttaagatattaggagtgtctatttataagagctcattttagaagtgagttatctttcatacagaattcatttgtccatatgggattttaataatgcattgtagtaatattttattacaacacaaaagatatcagtctgtaatttcataaaatggtttgcaaagcaactcaacattactttcaggaaataaaagtttattacttcagttactcattagagattaagctacaaagttagtgataataaagataattgaatacaaaagaaaccttaaacaggacacaagcctcatgctattaattatatatgtgtgtgtgtgtgtgtgtgtatgtatatacacacatacataccgatttatttgggttaggaaaatatcaatacaagtagtgactataataaactccattttgattttataaccatctagtatttctaaaggaaatattaaattttatggagcacaaactaatttataatatatgccaattcttgaagttaagctgactagttaaacacgtttatgaagtcttgtatctgcttcctcagacatttcaaaggtatctaaatcacatcatgagtttagagtcaaacttcctcaacctgagttttaatatcctttcaattcatcatgtacatcagaaggaaataaggtatatgacagggaaaagatgagagaacatactattatctaagctgataaaaaggaaaaaaatagaaattaatgatcatacatttgtgggtgggcgtggtggctcacgcctataatcccagcactttgggaggctgaggctggcagatcacttgaggtcaggaggtcgataccagtctggcgaatatggtgaaaccctgtctctactaaaaatacaaaaaaattagctgggcatggtggtgcgtgcctgtaggcccagctacttgagagactgaggcaggagaattgcttgaacttgggaagcagaggttgcagtgagccaagatcatgccaccgcactccagcctgggtttcaaaaaataaataaataaataaataaacaaacagacagacagacagacatttgtgtattattcatgattgacagacactttgataaatttccctgcaagaaggcaaaggttaaactttctgtaatttggcactacagaatgatctctggttacacaaagacatctaaaatattaaataaattgtatctctagttgactagtgacttaagttatttagctatcaaaaggatatggacatctttgtcacaaacttgtcatgcaagtcctcaggagggggaaaggtttccaattccttctcaagctgttgaagctgccttcccatctgcctcaaattcttttccagcgtttctacagagactaaaagagagtatattaaatgcccggaaaggacaaaattataatatataaaaggtaagacaccctagaaacaaaacattcatgaaaacaactcacaataatgtaagaaaattcattataaaataaaaataaatttcacttttaacctttcaatttaaaatctagttataaaagaaattcagtaagacagtctttaaaacgtaagacaaaatttaagaaatgctcacacacacaaataaaccacacttcagaaataagtttcattagaattcttgaccattggaaatactacaaaatcatcagtctattcagagacaaaaagaaaacattttttaaaattggactgatttaaatataatttgaacatttttcaaaatcatctcttgacagggaacagtgagtagatgggaaagatggggaaaagtgttttttattgtccaagcttatctacaatgggaaagaaaaggtatcagaggctacttataatgacaaatgtcaagctttctttgctgatatcctgaacacaatttgtgtttattatctaataatatttttccttctttgacttaaagtggctctcacggtacacatgaagaagaaatggtaaaccagggcactgtgtcactatgagaatatactagccacccagcagaacagacattaaggatcatttctgaaaatcttttcatagtcaattttatatgacaccaggaaaaagatttaatagtgcaaaaagaagatagagtgacctaaaccaacttttaaaatatttgctttaggtacaaatgaattctaggttaaaaaaaaatctattgtttttgttcaatgtgaactatataaaatgatgtttaaagaatgaatacagtaattcaaggtaatctgccattcttaggatttgaattaatcctgaaggatttgaattaatcctgaagaatgggtgcaattcaagttttatctataaggataggaatatccttggaagcaatctaaatgcccaacaaaatgaaactgagttgttttttttttaattttagcttggttcaaaagaataaaatagtaaggagacattaaaaataatgtgtaagaatatgaaatggtgttttattgtttttttaacctggttgtacagaaaataacatttggtattctgacattaacagcttttaataaaacctaaatgtattttcttattttaaaaaattagcaatctaattctcagatgcaacgtttaaggagtccaatgattgaactcttccgagaaccacatataatacttgtttgtgcttgaagagtgatggtactttaactgtttgctcccactatgatgaagctagtctggatttacactcatgcatattttctcagtaggttttttttttccttctcacgtattccctttctgtgatactttgaatttacacactaaatgctataataatacacactattatctgagtcattgtctcaaatttaagaatcacatattcttacctttttaactatttaaattattccaataccttgctgtgcattgctcatagtggtaacatatatttcctatgttatactctttcatttttatgtctgcttgtcaattatccacaaccaagattctatttgattaggccaatggtgtttcatttactcttcccgtttccaacttttttctttgcttctttcaaagttctctatctgcattacataagagattccttttgctctcctagtctatttgatctctcccttaaagtctcattagcatttcctctatcatttttcaagaactcttacaggtggttcagtcactttttatacttcctaaaactctgcaacttctgactaaataaaggttcaaaagcaagctgggcatggtgatgcacatctgtaatcctagcactttaggagctgaggtaggaggatcaacttgaagccaggagttcaagaccagcctggacaacaacaagactctgtgcctccaaaaattaaaaaaaaaaaattagccagccatggtggcatgtgcctgtagtcccagctaatatggaggctgaggtgggaaaattgcttgatcccagaagtttgaagctacagtgaccagtcatggcaccaatgcaccacagcctgagtgacagagcaagaccctgtctcttttattaagtaaatacatgctcagaaatgtttataagccatacatctactttgtgctataaattaggttcaaaaaagtagtgtattagtagtataatggtagcagtaattgttatattagtagcagtgacaataaaaataatagtaatggtaataacaacatctaaaatgtggtaagtgtttatgtatgtcaggtaccgtcttaagtgttttctattaattaactcatgcaatcctcaccagaacatcatgaagtaggcattattattattcctattttacagatgaggaaactggagctcagtaggtaagtaaaaaggtcaaattaaaaattggtgaagctagaatttgaattcaagcagtttcattccagaccttatttttaaccactgtgttatatataaattattatagaaattaccattttgttttcataacccctgtcagtaacatttaaataaacagatataattttcacataataaggggtttcttgtacattcttgcccattgcaatcacaagcaatccatattccctgcctaaacccagggaatatatgcctaagcattctggatggacgggtgagtgtgcagttatatatatataactttttatatatgtatttatttttaagtactatatatattaaagtggtatctcaccttgaacaaaaccacatacttaaaatacttagtctgctcaaccaattttattatgcacacatgtcaaattagcaaaagatctagagaacagaccaataggtctgagggactcccatatgagaaaaagcacagggcaaatgttgggagggaacatagattgtttgattttttctctgacaccaaatacattgttccaacaccaatcaattgtctaattctccaataccaactgggtgtcctacaattggagttagtgcagactccataagttaaggagaaaatccttcaattccgatactaactacccagatttagtgtcaggctgtacaggtagaagggctcactcccacaaaactaccctcatttcagatgccagttgccagtctagaggaccactctagactgactcgctataaatctggggattcccaaaactcccttccctgaagttccacaattcactagaatgactcacagaaatcaggaaagcactatacttatgattgtagctttattatgaaggacacaacccatgaacaaccaaacggaagagaggtacaggacaaggaatggtgggacgggggtggtgcacagtttcactgcccttccagcacttccaccctccaagcacatccatgtgttaccaacccagaagctcccccaacctctttcagtctttattgaagcctcattacaaaggcactattgattaaatcactggcatttgtgattgagctcaatcttcagcccctctcgcacccatacattgggtataagcccacagttctaaccctttaatcgtatgtttactacttctagaaaccagtcttcatcctgaagctatacccctacctgtctttagtcactacattaacatacaaaatatgtgtcactcaggaaattccaaaacttctaggagcttcgtgtcaggaaccagggggcaaagaccaaatatttacttttcattgtaccgtatggatatagaagtacatgtctggtcagagggcagaattccagtagggaggtgtaagagaagcacatttttggctcattctcagaggtgcctaaagtctaggctgccctcagaggaagccagctactggtaactgaagatagagctaccccaatgagtgagtgcttctcagctaggtgggagagggacttagtccactggataaaaggcctgtgacttttccaattctgtggttgtcagtgggtcaggaactatgctctttatgattggaagcaatttctcctgggcttgatttccacattagtgaaatgagaaggatctcaccgcgtatttttacctcacagacatttcataaagagtaagcaagctatcttcaaaaaaataaaatggttcttgaggctactctacagatgcaaatctcactaagccatttcttgtgcttcaccagaagtctctgattatttgcacattatttgcacattatggttaagcagatttaaatgtaattgaccaacctctcacttggtttttaaataaggaccaacacacacttggaagaaagaaagcagcgtgagaattctgggctaagaaaatgtatgccatctgatgggtaaaactaaagagcattttaagaattcccttgctgtatttataagtcggatctgaataatgggaacacatggacacagggaggggaacaacacacagtggagcctgtatgagtggcgggcaggaggagggagagaatcaggaaaaatagctaatgcatggcaggcttaatacctaggtaatgggtttatagatgcagcaaaccaccatggcatacgtttacctatgtaacaaacctgcacatcctacacatatatcccagaacttaaaaaaaaaaaaaaagaattcccttggtgtttttattttttcagcaattattctatttctatagacaattcttgtatgtatcttcaaacataattttagccacatttttcacatgtatcaggttctttgaggtcaggaactatattttatgtcttaaaaatcttaactatatccagatcacgaggtcaggacatcgagaccatcctagctaacacggggaaaccccgtctctactaaaaatataaaaaattagccaggcgtggtggcgagcgcctgtagtcccacctactcaggaggttgaggcaggagaatggcatgaacccgggaggcaaagcttgcagtgagctgagatcgcgccactgcactccagcctgggtgacggagcgagactccatcccaaaaaaaaaaaaaaggaaaaaacaaaacaaaacaaaaactatatcagggagtattaaattgtacactcttaaagaatttttaatttactggtgtctctgtatgtgacctatgtgtgaattttatctttcaatcttctcaccaagaaattaatcatattttttgtattcctgttcattctttggaagaaaactaacaaaacagagccatcatcaaacagagctagctagacaattttgacttttgcattttcctcagttaacattccaccagatgacatctctcagtcacttcagacatcatgtgtctctatctccaacctgctccctatgtgtaatctccataccacagaaggcaaaaggaccataaatcccatttcttgtgctagaaacctgctggtcttgaccctttcctctcttgcaattctcagattcaaacaatcatgacactcaggcattttacttgacaaatagtacttaattccttcctgacttaacacctttttttctttctctttttttttgagacaccatttttttcctttttccttttttttctttttgagatggagtctcactctgttgcccaggctggagtgcactggtgtgatctcggctcactgcaaactccgcctcctgggttcaagcaattctcctgcctcagtctcctgagtagctaggattataggcataaaccaccacctggcttatttttgtatttttagtagagacggggtttcaccatgttagtcaggctggtcttgaactcctgacctcatgatctgcctgccttggactcccaaagtgttggaattacaggtgtgagccaccgcgcctggctgacttaacacttttaaagtcatagggaacccttttgtcttctctgatctctggtctcctacagtttttctccagcgtcattttcacactgtgcataggggtttccagacaatcagtaaagctgcccctttcctgttcaatgcatgtcagtaaactggttacataacatctgagttcctaaacaaagccccacctacaacctggggtgctctacttcatatcctgccaaatattcatctccaaaatacatactgcttatagttcccctgcccatatccctcttcatctaatctgtacctgatcctggaaataatgtgtgtctatctgccttgtgcacttcacccctgggtcataaccattcataatttacaaggaatcaaaaactacagcaagtacacaggtaaagtgccctttctcccaatcacaactagtaattatctctatctttgcaattactactctctatttacatttatctttttatctgtcttcctctcccaaatggctgggaattccttaagataagacaccattcatctttgtattttcgttacaaaacatattgcagatacccaaatgtttgctgaaggaatgggttttggatttaactttaacctcgccagataagagcgttaaaaatgaaacaggaaaatataacagattaaatatcccagacattaaaatcaaagacacaggctttcctccaagtgtcttattattatgataattatacaccagaggtgttaaagaagctttagagtaaaagttaaaatcgaaactataaatatttaagtttaaagcagtcatgaatacatgctttttataacaccatggcctctatgatttactagattaagatttcaagtaagaaaggagaggttacataatctttgtaattaaaaaaaaaaatcctctatgaatatctcctggaggtgttggtcattatttcataataagcttactaaaaaatgccacactcactcttacacatcatgatacaatccagggaaattgatttctttaaggaaagcttaaagaacaacttattaccatagacaatttaaacatgcaaactaaatcaaaccttcctacactcatagaatcaattgtttcatgtgcaaaattatttagtttcaggctccaagcaatatatttcttcctagacaactgtaataataaaagcattttataaagctatagcaacattttataaatgcaagttaaaataataaaattgtatggacaaggtggtccaaaacaaacctcagtagtataaaaaaaaatcttgactattaagtaggtctacaacaaaacctaaattctagaataccattataaaatccattacatgacaaaaagatacaaaactaaaacaatactgaaaaaaaatcaaagtaaaaataaattgtagcttagttcgtaacaggcaaagataaattgaaagaaactgtgctgccgggtgcagtggttcactcctgtaatctcagcactttgggaggctgaggtgagaggatcacttgaggccaggggtttgagaccagactgggcaacacagtgaaaccccatctctataaatttttttaaaaagattagccaggggtagtggtgcctgcctatactcctagttacccaggaggctgaggcaggaagatagcttgagcccaggaatttgaagttacagtaagcaatgattgcatcactgcactccaacctgggcgacagagggagatcttgtctcaaaaaaaagaaagacaaaggagcaatgctaagtgaacagccagtcatcctcatcaagtagttgtaccttccttgacttacctgactcagatcttctttcttcccattgttctgattcttgatggaaccccaggtaataacaaatggaatttgcattccttaattaatttactatactgtatgcaatgatggtttaatttttgttgtttttacataatactgcaagagaaatgccttcatctgctatggaacatggaaagaagaaagggagaaggcaagtagaggaaatgaatacaaccaattaaaggcccccagtcaattctgttgagctatttcatcccctgaaagaaagagccagccctgtcctttacaagtacaaagagggtattaaaggcggcagccttttagaagagaaagtgtattagtgggagaagcccatctcaaaggaaatcatgtttacctataagatttcagaattcccttagataagatgttcaaaaccatggtataaatattacataagaggtgcataacagaaatgtttaataacaatattcaaaatgttcccttagtataatggttctgtgtacatgtacatgggagggcaattttactgctttttactttgtcacaggggaaatgttaagcacagactgactgactttcaagtaagactagttttcacttgctgctattggagaccaggtcagcctcacaattccaagattgtgtattagctggacttcaaaaaagtccaaattttttctcaagcctagatccttcccctgaactccaatggcctatttggacatgtttccttaatatttagctggcaccttaaactcacttttccaattagaatttatcttcctccttgacttgcccctacatcgcagtaaatcattagtttttataactcttttctctttcatgccgcacacatctaaccatagagcgcatcttgctggttctaacctcaaaatgcattcgttttccaaatacttcttaccaccctcactactcttcccgatccaagccaacattattcctcctctagattattttaacagcatcagagtggttttactcattctaccattattcatctacactttttcctcaacagagcagccaaagcaatcctttgaaaatttaagtcagatgtcactcttttgctcaaaaccttccgtggcttttgagtggctcctcatctcagagtaaagtcaaatctttttttttttttttttaattattatactttaagttttagggtacatgtgcacattgtgcaggttagttacatatgcatacatgtgccatgctggtgcgctgcacccactaactcgtcatctagccttaggtatatctcccagtgctatccctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattatgtgaagaaagtcattggtagcttgatggggatggcattgaatctgtaaattaccttgggcagtatggccattttcacgatattgagtcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttattgatttttgtacattgattttgtatcctgagactttgctgaagttgcttctcagcttaaggagattttgggctgagacgatggggttttctagataaacaatcatgtcgtctgcaaacagggacaatttgacttcctcttttcctaattgaataccctttatttccttctcctgcctgattggcctggccagaacttccaacactatgttgaataggagcggtgagagagggcatccctgtcttgtgccagttttcaaagggaatgcttccagtttttgcccattcagtatgatattggctgtgggtctgtcatagacagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagtagcacatcaaaaagcttatccaccatgatcaagtcaaatctttacaatggacagtaatgccctacaggatctattacctttctgaccttatctcctattatgctccccctctctccctctgctccagtctcacttccataccttgaggcctttacacttgcttttccctttgcctggaatagtcttctctcaaataccaacataaatggcctctctacgactcttttatgtttttctcaaagaccactttctctacaggaccttttctgaccactcaatctaaaactgcaaaaaaccctgccctggcatgccagagtcagacataagacatacattgacttctttcattggcttggttctatatctgccacctaaaatgtaaacttcaagaaagcagaggcttttgtttttacagctctttggtgccttggaatggatgaggtattcagtaaatgactgattcaacaatgaatagatgaatcttttttttttttttttttttttgagacagcgtttcgctctttgcccaggttggagcgcaatggcgcaacctccgcctcccgggtccaagtgattctcctatctcagcctccccagtagctgatattacacacatgcaccaccacgcccagttttttgtatttttagtagagacggggtttcaccatgttggccaggatggtctcaatctcttgacctcatgatccgcacgcctcggcctcccaaagtgctgggattacaggcgtgagccatggcgcccagccaaatagatgaatcttatttaaactaactttatttttttttttctgtcactcacagtcaagcctaatccttgctaatacaagtgcctagcacaatgcctaccaaacaggagttcaataagctgttttgagagtcctttccttatagagtcaaaacatatcaaaaactactaattaacactagctcttttttccataaaatatggtttgaaagatagctgccaagaagccaccatcacagtggtagacacttatatgacaaaagggtctcactgctgatcaattttaaatctatacttaaaggtgatctcttctgaggggagaaaggacgattacccaatatcttattttctttaggttttcctatgagcgtgaataaatattattttagattttcctagcacttatatcatttctcataaagtagttcatatttccatatggcattccttcataattcttggctgaaatgaaaaaatttcttttttaaattcatgcatcacctccagaaaaataaactcagagttgaagagttgctggagaccagttgttttcaaaggttgtttagtactagaactccgttttcaaaagaaatcttatgtcaaagttcaaaatacaaaataacgtgttgcaggctgaagcagaggcagaaaaatagaactcattttccaaattccattccctatgttagtatgtccaactcgtaaaaatgcattgagctgtacacttatgatcctgtacacttatgtaactgcatgtgtattattctttaatttttagaaaagtaccaacatttttagaaaactactaacataagcctacaaaatttgcagtcgttatgttctaaagtttgaataagcttcaggcaacacacagttggaatctgttcaaatttctgacaatacatattaaaattctatactaacacattattcacatagactcatgtttacctgcactgttaatgacaggcagatgtgtgccaacaataaataatcacggaaaaataacacccacactataagaaacatggagaatatttatataatgattaataggtacttttcaaacttgataaacatttgtacatattaacctatttaatcctcacaacaaacatctgggttaagtactaatattgcacccattttataggtaggaaaagggaagctcagacagaataagaaacttgtctaagattatacctataacaagctggggtttcaactccaggtgaaccagttacctaacctcagagtccatggtccagataacagtttctcctatcatataatgtttctataatctaattgcaaacacatttttaattttgcccactaaaatcacttattacagttattgctgttatcatggcctatcaataaaaaaattccttaaattcacaggctgatatggtttggatttgtgtcccctcccaaatctcacgttgaattgtgatccccagtgttaaagaagggcactgataggaggtgattggatcatggtggtgagttttcctcttgctgttctcatgatagtgagtgagttttcacgagatctggttgtttaaaagtgtgcagcacctctccctgcactctcttcctccttctccagccatgtaagatgtgcgtgctgctcctttgccgtctgccatgattgtaagttttctgagtcctccccagccattcttcctgtatagcctgtgtaactgcgagccacttaaaccacttttctttataaattactcggtctcaggtagctctttgtaactatgcaaaaacggactaatacaaaggcatacaataatttcagttttaactggtttagtattttcacacaatgacaaagaaaagggtatttctgaagcatattaacaataactttaaaaaccaaactatttcacaatttaatgatacatgctttccagatatgcttattagtataatttccatgcactgtttcataatactcaaagatgacagtgctatctccatgcagttataggacttatgccaaagatgactgtagtgggtgagtagtgccccccaaaaatgcatatccacccagaacctcagaatgtgacttatttggaaataggaactttgcagatgaaattagttaaggatcttgagatgaaatcatcctgtgactgacatcatccaatgactagtgtccataagcagaggtgaggaccccgagagacatggagaagatggtgagaagatgcaggcagagagtggagtgatgcatctacaagccaaggaacacgaaggactctgagtagccactagaagctggaagagaagcatggatgcttcctcccctggagtcttctgaagatgccaaccctactaatactatgatttcagagactttagtgagagacttaatttctgttgtttacaggcactcagtttgtggtaattggttatggcagccctaacaaaccaatacaactactaattcaagattctgtaagatgcataaatacattctggtttctggagagcagctgacaattctacctgcagcatttgattatctccatacctcttcccccaattggttacatgtcaaccttgtctccaacaagattcataagattgccattaatgtgtttgctctatctactgcttaggtttctttgtagtacacagatttgttatgttaaactgtccttcagaatatactattctgaaattttctttcacctacttcatattgcaaaactaaggtgcagtaaatattgctttacagccacaagtgtaagagagttctaaaaccttggtcatcactggtgatactgtcctgttacttgatgttcgctatagttcataggtgacactgacagaactgctcaagtagctacttcaaatccgtagctggcccaaaatctgcaaacactgtaaactgttagtttctcgaaaagattaatgatgtattgatgacactttcagcctgttaacctccaaaaagatatagaggtcttcctgatgtggttttcttcttcatcatcatctattagcccaagccacagcagattcaggaaatgttcctagctcagtatctcaaaaagcaatctttagctgcaagtagttcctctgtgcccagtgttctttaatgtcaatctacagaatccttaatccttctagtgatttttgggacattctctttctattccactctgctgctttccaacacagtttatatttgcactgcaaaatgattactcttacaatctcatatccaagtctacaacttaaacttttcatgccaactctatacagataatccctggaaataaactggcaggatttaaatatgtggtctcttaccactataccacacttgcaatacactacaaatatttttcacaaatcctgtaattaccttgggaatggcccagttatatctcatcatacctttttgtgaaaaaagtattaatttattgaacataaaattgtacatattctaacattttggtaagtatatgcaaacatatataaattatattttaaaaataaatttaacttttattatatttggcttatattaacattaaaattattttagaattcctaagtatacttactaaatataaatgtaaagtatactaatgtatgctttagaattcctaagtaaattcctaagtatacttactagatgactgcagatagtcaaattagttccctgagacataaaaccattaggagtcataagctggctttacgaacataggttttactccacagtctatctgtagaaccagcactacacaacttggatatactaaatactttcattattcccacaggaaaatgaaaaaaaaaaagtaacatcatccacctatgccttacttttggaaaggtgtcaagagataactcagagtgttactaatgtttatcagttacctgcttatatgaaaattacaactattatagtagcaaaacagggagaaatggaaaagaaacatatatatatttatggatatatatatatatggatatagtgagtaaaagaaaaagacaaaacaaaaacttggtatagtatgattaactgtattctaaaacaaaatctaggaaatgccgtagatctaatcctgaaattaaatgagaattttcatgaatatatttatttaaaatgccttaatatatccttatacatgtactactttatgtttcatgtctactcaaaagaggaattgaagcatacttgcaattatttcaaaacatctgataattcagtttgtagaagaatctttgatatttctaaattgattactagtgcacatccaacacagcagctctacaactgctacttcaactgatttgataaagtgaaaaaccattcagtataggctactgtattctatagccaaagaccactaagcaaatgagaaaaatgtcttaagttagtatattagtttgctagggctgccttcataaaataccccaggctgagtggcttaaacaacagaaattcatttcctcaattctggaggccagaagtccaagatcaaggtgttggcagagttggtttcctctgaggggcataaggaaatgatttgctccaggcccctccccatggcttgcagatggccacctcctcactgtgtcttcacatggtctatcctctgtacatgtacattcctgaatggctgtgactctaaatttcctcttcttataaggacacaggtcagattggattagggatatcctaatgatctcattttaactctcctctctttaaaggccctatctccaaacatagtcaagttctgacatactgaggtttagggctttaacataggaatttatgagggaacagtacagcttgtaacagttagaaaacatttttgttcccttgaccagtcaataaaagcaacatcccacatggttgtcttctataactaaattattttatcataaatatttccaccaccaacaatgtaacctattaactacatcatataggcagatattggtaaaaaaaaaaaaaaagtgtcttttcataacattctaatattctactcctgatttgaaagaccaaataatatatcgtacacaaattatgaggccccaacctacaacctccacgacataatgattccaaccaatataatgttagctgtgttgttgactctgctgcaggggatataaaatgcaattaaactaataactaatactgattattcaaaatatgtatcaaactcactaacaaattgtaactggcatttttagaaggctatagcaacaaagaggttaacgtgtcttttggttatagcagataaatttgaaattttcaaacactataaattttccaggtggttgccacctggaaattaagtgttctaagtgctcacagtaggtgaataaaagataaacatttggtatttagtaagacatttatcataaaatgatggaaacgcatgagaaactggaaaccaggagacgtatttgagcagacaaatattagggtcaaatcaaggaattgctagctaaaaacatataaacagagtcttagaagcagaaagcatagtattaaatggaaaggatttaaaaatcaaatatatcagtgaatgctcttaatggtaaaatatggaaacagagaaatatggcaaaaattaaaaatgagttaacattgaatccactctgataatacactgaatattgatctcttctagaagcttaaatctattcacagctgtcccaggaataatccctggtctagagcagcagttcctaaagtataagaattcctggaaaacgtatgaatttatccttaaataaagagtagaatacacaaatttaggtgaggttcccagcaaaaagcaccaaagggaaggtgacatttacttttaagtttcttgatgaaggagaaaactagacaacattcttgccacagctgccacttcccatggatttaacttaggcaaaagccaccatgcagctctgcattgagatgctgaaggctatatagagatatgacaaatgagagaaaagatatccaaagaaggggagccaagcaggattttttcaagtaaacaaaatttggaaggagaggttaagggtgtaggaatcaaaagtcccattttgtggcataatatgattctgacacctttttgagatgctatggaaatagcaaaagctgttgtctatagaagtgtggatcttagaaggaaagtctgggatataaatttgtaagtctttaacataatggtggtattatgggaattgaaaacatcacctaaagagaagatctagggagaaaagaagagaagggttcaccattaggctagtgaaaagcacttttaaaaaagcaatgcatagacactgcacagaggaagaggagaaagtaaaggaaattgaccataggagggaagagccagctggggaagagctagatgggagtgagacagattgggtttcactaagacacagacactacacctgaaccaagagtaagacaagagcacagtttctgacacagtgtaatcactcaataaaggcttgttaagttagtgattggatgaatgagttacagactgaactagcacggtatttctagaattaagagttgactaggaaaggatggaaatacatggtggaattataactctaaaaaggtcagaccaaggtgatgttgtaaacttaccttagttttattttaatatactcaccaacaaaaaaaagtaagttttgtcatattttttactctttaataaaatttaataatgaaatagattattgggaagtaatcaataaaacctttatagattaattttaactgcttagacaaggaaaaatgtattgaaccttagaagtccaaaaagagagaaatattacaatggtatacagaaatacaataatgactaaaaatatttccactgaaatgcaacagaaaagttgtaagccattatatcttagaaaagaagcagtcctaatgaagtagatttttgaaaattgtcatacaggtaagctcattagttgcaatgaaagttctccctgctgatctaggagtacttaatgaccaggatttgttatgcctcaaaaacaaaggtactttttaattcatgtgatagctcactgaggaggtttcaaatctggaaacttttaaatgatgatatataacacgtgtataagagcattaaaatactccaaagcaaacacacttacctcattcaaaatattacattttctcctcaaatctcattaataaagtaatataataataaaaaagttatgcttaacaatcacctatactataaaaagtacttcagtgatggcttttctatgttaaagatgaagttggctgctccctgtgaaacatactaacggtgtctgctgacccatacacagacactagactccactcttaacagatggaaactaaaaagtcccaaaaccccagaacgccctgctgaaacacaaaaacaacaaaaagaaaaatacccagaagaaccaaaccaagttacagttctgcaagtccttatcaaaggtaaatatttttaaagaacaaattataatatcaataaagaattttaagtatgagtcaacataaatatttcaaaaacttcatttacagcaaaacctgctaaacaataaattctacaataaaaaatacatctactcaaccatgtttttccccaggaaaaaaactcccggtgtatttcaaggcactttgtacctaccatgttttcatccactactccgttatctatcaaactgattaatgtccatcaagaatactcatttccaatttttttttatcccatttggtcaaaaaatccaaaatatcagaattctctctttaggagagttgatttccctgaggtaaaagttattttgaatatcactgagtgattctgaatgtttacaacccattcagttcaatgcccttttgccctatctcaggtgatttaacacaagaaaataatttcaattattttcccttcttgaatcctattaaaacatctataactatatatatgggaagattcttcttatagcaaggacattttcaggttgcagaggggtaaagtgagtaattcaataattcattggaacactaggatttattagtgaaaatttaagtaaaaggcttattttttgtcttacaaatcaagacaggccatatgaaatatttacttcaaggaaacatacatctcagaacaaagtttcaaagaacatctcatccaatcacatgcttctttgtcaataaagttctataatcctcattttatagaagaagaacaatttaaagggagcaggaaaagataaaattaattttttttaaagaagaaatattcactctaatatggaaaacaataaaatatccttcaagttgatgaattccaatattaaaaagaaaataaagaggttataaagacaatttcatattactaatgactagtagtcaacaaaaaaagaatacagatattccagcattccagatgagttgttttccaaaatgtattcataaattggttgtttgacaccaagtaaagttgaaagaatcaatgtgaaatataaatgaaaattgaggccgggcgcggtggctcatgcctgtaatcccagcactttgggaggctgaggcaggcggatcaggaggtcaggagatcgagactatcctggctaacatggtgaaaccccgtctctactaaaaatataataaattatccaggcatggaggcgggtgcctgtagtcccagctactcaggaggctgaggcaggagaatggcatgaacctgggaggcggagcttgcagtgagccaagatcacgccactgcactccagcctgggcaacagagcgagactccatctcaaaaaaaggaaaaaaaagaaaaagaaaaagaaaattgaattattaaggtagtcaaaaaattatatttaaatcatattataaccaagtattaataatagctctatccgttctatgaccctttatgacctgatctaagcccacaattgagactagaatcaggttagaaatttgggcattaggaaagagtgaaatgaaactctggcagtatggtgtcttctataacaaaaaaagagagcaccaacaagttgggcagagatagatttggtactcaggtaagtagggagggacactgattgctggttctggtatcaggtatgtaataggctatcagtgcctatgaatgacattgaatcaagagagcatcaccctggccaaaaagtgcaggagatttagcagtagaaggtagggctagcaggtatctacaaggtttaaactgtaaaacaaagtattttataatataaggcctcatcatctaactaaacaaattaaactcatagctccaatcatgacaactcataatatcctacaactctctttatttttaaaatgagatattgggtatgaaaacactgtgagaaagtggaaagtacatacaaataaaaggtataattttcagtcttttagcactgaagatcagagccatgaaatgtttcttaaaaaggcacaaacctttactagctttgtctaaaggttccaaatcatccacaaaattcagtatatcagggtacttctcttcacatatttctaccaggaaatgaagtagcgttgttttctgatctgctgattttgtgtcctttagctaaatagaacaggagggagaaaaaacacagagtcataagtatgttgatattctgtctacttaaataatattaatactgtattttgtagataaggactaaaagttgtaaaattagttgatttcgtttttgaaaaacaaatatttaaatactcgaaaaactacttttgacttgctgcttggtgaaaatcattatttgtcgcaaaaaaggaataagtttaatcgagcatgcaatgttttatagaaaaaaatatggaaaatgcctaggaaaacagagtaacctatgagtctatttaatagtagtatttaaacatccttggcattcatccatttatcacttggcacatatccatagaatgcctactagctactgtagtagttggagacctaacaacaaataaaacatagactttcctcaagaagctgtttagttaaaaaatatacgtatttgccttggtgtgacaaatagtatagtaaaaataatcacaactttcatttaggaggacatgacaatggaactgagacttcaaagacaggaagttgtatgggcttagggaaaagaaagaaaaaatacaaaagtgcattaacacaggctcatggagcagcatttacaagggctatagatgaggaaggatatgacacctctgaggcagctgagtgactccagaattaaagtgtatctgtattagggaaggcatgtagggacatggcaaagatataaatctgaaaagaccaaaaaataaaaggaaagataatggcatgcaatggaagtaggattttgattttgaagcaatataagttttccaactagatgagagatgatcagatatacattttagaaagctccctccagtgagtgtggctaaaaagattagggcaagagtactaagagaagcatgaagagtgagttaaaaacccatggcaataatcaggcagggaaagagggcagtctgaatggaggttgtgcctgggaaatggggacaatgagaccatgtgggtgtggaaacccaggtgatgctgttaactaccatgtcagaaatgatgagaaacagatttgtgtgaggtggccaaagaagaaaattgttttggacaaggtaaatttgaagcttttcagtagtacccaggtggaaatgtcttgaaagaatatacatttatctatctatgtatagaacagtgctttcattattttttttcatgattgccccctaagaagtttttaggcatttttttcctaactgcacctataaaattttaaaatcacaaaggtgatgcatttatgtttatatactgtatgcatatctgtgttttacacctaaaaactggttaaacaagtaagacatttttgctctccaagaaccaactttttatccctgaaagatacctattgaaaatacatggttaaacctcagaggaataaactggggcaccaacttgtgacccctttcctcccaaagctaattagttgatcaaattaacataaacaggtatgtagaatgaatgaaaagaggttacgggcttgagacgaccagggtggaccaatcctaatctgaaatggccaaggagtgcaatcacagggagaggtagttaagctaaaacttcaacaatgataaaagttagcttgggttttgtgtagtgttgggatagaaagtattggcaaggaggagtggtatgaacacaggactaataggtaatctggtagcattccctaccattaagtaatcatttagagcagagatacaaataaagggttaaaaaaaaaatcagtcttttctaccagaatttaatttacagctggaaattcaaggcatacctaattgggcacagtactacttacttgcttcctttccaagaatttccaactttaaaattggctcctaaataaattcccataagtaatattttaaaaaatccaacctcactaaatattctatcactatcagaaaaataccaaataactgttaaagtccagtagtggaagaatgggagatttccgtaccatcagacatattaacatactgactacttattgattcaaaaactatcatagagccgggaacagtgagctacccacctagacagctttactttcacatcatgacacatgtaataggttcaaatgctatgctgacctacacaacatgcaacttatacagtggttcccagtactttaaaaacagactgaatatgaacacttagtccatgatttggtaccttgtttaaaagaaatacagatttcacaacatagagctgagtgttttacaagaggatgcctcaaaaacatgactccattgactacctagacaaatagtcactaacatacgtggatgatttggcaatgttaaaacatgtccttgactaattaatagtcttgagcacattactggaccttagctttcacacaggtaaaataagaaaatgaaacaacatagaaactctaaattcactttttactctaaaaatgttaagtatacattatagtggaactaagagttagtagacacagtacaatttaatttttaaaaactggaagagtggagaaatgtagtaataatctcatttcagagttatttctgtgtgtttgggtcagttggaatcattctatgggcttctgtttttacatatagactcatgaatgtcaaatacaatctttaagtttcgttacaatcctataatttcattcatactatcatcttaaataggtaaggccagattaaaagcagcaaacttttacaaacagttttctctttgcacagccaccaaaagttaacatgaaagttgtattctgttttgttaaaaagcaccctagtagcaaagatcctttatctcacccaccctcatttacagcaatgactacttggggaacactgttcctactctgaattctcggcaacccatttttactagtctacacccttgtagactgtttggaacgttaagacaatcaccatctaccttcacaatttgtaaagcctagaaagagtattccaatagtatctgtgatatagctaaacagccagcaactgctaggattaacgtatcaagaaatctcaatgacggaagaacaaccaactggattgctcttggtctttatttgtaagcaatgagaattcagaatttagaatcatggaaaacaatgtagtttgtagcaacttagtttaataaatgttaaatactcaagtcaaacacagattcgagttattcagagaccattataaagctaaacactgatttaggaggagggtgctaccatgggttgtcttgttgaaaacatcaactgagtagcaagcagcataatgggaacaatctagtattaaaaagtacactcactgaatagtaaagggaagcacaatattcctatcatttcaaaatgggtatttaacaattgaaagacaccactcaaactttcatgtaaataaatttgaaactaagcctaataaataagaggttcagaaaagaagcatgttgttgatcatgcatggtgtctcatttataaactactatgcagctctaaactccagggcagagattcttcatttatgctctaacattctctagaaaaatttcacaatgctgccaagatactcttcctgcctcaactactctattctctccctcccctctctctaaccatcttttaaaaagtcttccaaaagcatcaaagcataaaatgtattaggtccttatccatttgctcaatatttttttcatttcattaatgaaaattaccaactaaaaaggcacattctactcctactcatatcatactcactcatatcataatcagtttctgagctagaacaagtaaagcttggaatacagtgttaattttgttgaagatgagtaacaacttatgtaaactttgtaacgctaaatcttggaaagaaaataaaatatttgctttaaaaatatcttcaggttaaaagtatgctttatttaaactttaacagtcagtgcttgacaggatttcttttgtattactgtcaagagatttatcttactgatgagtaatcatcaccgttaaacagaatttcctatttatgtattgtttctttaaggtacatttaacgtggcataaatgtcaaataaacaaaagatggatggagtttctccaaccactctgttcattccagacaaaataatgttaaaagtggatcctgtaataaatcatggcctagttgtcagtctgcagtaaaactcccttgcagttacagtgcaaggtttggggatatttttgaggtattcagcacaaatctggatgacatttaaagaatattccatttatttagtcacatggtaataatttaaatttaaaccctaaaataaaaactaagcatcttcgtgatcttcagaagtcaaggaactggaatcccttcctgtttgaaataatgaaacttacatcttaagaatattatcacattaataactctactccgcatcattatgttcctataatctaggtatgtatcaaagcagcattgaatatttagatgtttagatgctgtggacattagtgaacaccagaaacaagacaaaattctgaaaaatcttgtaatggcaccattaccattttagaagaatacaacctgtgaataatattaatgctgaggatgacagtagcatcctcagcattaatgtttggtacttaccatgagacagacattagccaaataatataacacatgttaagtgcttaaaacattacaaccccaaactagtattatatccattatttaaaaaggaaaatggaaatttagagagatcatatagcttacactggatcacatggagccaatgattggaacacatgtctgtgtgaatacaaagctcttatccactataaaatatagttcctttacagcaatctttagtctagcttattattaacaaaataaaccaaattctcaaaaaatggcagtaaaacaacaaaagagcactaatgcaatgtaaaatactagcaccctttaacctgttaattctagcctggaaagcatctaaaaacagacaccacactcccttgaggtcatttctagttctaagagcacaacattctattgttttatctgtaaaataaataaaatgccatctgaatcttatcaatcaaatagcaactctttatatatttctaatggattactgctgacaaaatatcatatgattgaagaaaaaggtatctataaagtttaaccttcaatggatttataccactatattttaatagcatcatatcccatctcaaatcttttgcagaataaagtggattgtgtatgcataaaatagcatccctaaaaataaaggtatctacgtgaaaatgaatgtatgaagacatactaacaaagactataacacaattgctcagacagaaagctcaaaaagtcaatgtggtagtacaaattcactaataaaaccaaccaccattatagaatggattttgttttctggtatgtacgtgtgcttgtgtgtgtgcctggtgtgtgtttgtgtgtgtatttgagatgggctcttgctttatttacatatatatttatttatttatatatataaatatttttaaatatatattttaaataatcattgtgctaacaaaatttttcaaaacaaaactgagtatcactccaatacaaatggcaatgaaaatcttgaagtaaataaaacaagatggttgaggcaggagaactgcatgagcctgggagttcaagactgcagtgagctatataatctctccactgcgctccggcatagatgacagagtgagacctggctcttaaaaaaaacaacaaaacaaaacaagcctaaggtgcttatgccactgccataaccacaaccattaatattaaaatataactttcttaataattctaaagatagaaaccaattgatattatataaattagatactaaggcatataaatactaaattacttatggcacccatatataaaaacaatttatattaattacttaatattcattttaaaatgataatgaaaattaaaacattaagtgaccaagaaagtgcattaaataatgtggacttccgtaattataatatgctaccatatccccacacactttctctgaattatatttttaacacatttctcttgaattacagtgagtgtagaaacttctatatagaaagcatttgtgcattttagtaaaagtttagcatactacattatctactgcgttgcactgttctgttcatactgccccctttttcctgcaaaagatataaaacagctcaatgttccttacaaaaaaggactattttcagttcttttagtactgagagatcagaaaacagacattcataacaggcaaatgggaaaaagtactagaataaacaatctgcaagggaacaaatatgattagaatacaaatatattttttaaatgctaaactcggatgatcaaagacataaaaaagatacaagatactgcttcagcaactatatcagcactctccacctaacaaaaacactctcaccaagaacaagaagtcatggcagggtcgcagtgagactggcactttcatagtgccagtctatgaaagccactgcaggcatgcgcaaatcagtaaaacctccaggaaaatgatttagtaacatacgtcaaaaattttaaaaatattcttgtttggagtagtttcagaaaactcactggagtccaacattgtccagccaaagctatgtaactaaactgctattttagagcacggatttcttaatctaataataagaatttctcatgggaacaattaacaaaaattggagtaagtgcttagaaagtgaacatgtttagattgtttatacaaatggaccaaatacattaattttaaaggttttttaacccttattaataattaactttatattttagactttatattttagagcaattttagctttacaggaaaaactaacagaaaacagagttcctgtatacccttccctacacacacacaaattatcctgttgtaaacattttacattagtgtggtacatttgtgacaagtaatgtaccagtattgacacgttattgttaactagtttccacgttaaggttctttctttgtgttctgcagttctatgtgtcttgataaactcagtgttattcatccatcactacaatgttatacagaatagttttaccaccctaaaaaattctgtgtctcacctattcattccttccttcttccctctcctcagaacccctggcaaccactgatgttttattgtctctagacttttgccacttacagaacatcacatagttggaatcatacagtagatagcccttccagtctggtttctatcacttagcaatacgaatttaatgttcttccatgtcttccattggcttaaagagatcatttatttttaatattgaataatattccaaatgaatataccacagtttatccattcacctattgaaggacatattgcttgcttccaagttcaggtaattattaataaaatggctgtaaacatttgtatgcaggtttttgtgtggacttaagttttcaattcatttgggtaaacacttaggagtgtgattactggatggtttgttctacgtgtagctttgtaattgccagttatccaaagttgatgtgccacattttgctttcccactagcaatgaatgaaggttgtactatatacttaccagcacttggtgctgtcagtgtttagtattttagcaatgccagtacatatgcagtggtgtcttattgtttgagtttgcaattccttaatgacatctgctgctgactattatagggacagaaaaattacaactccatcctcttagggtccttgctggtctgataatttaatttgacatgagagagattaacaggagaaacgtgtaatgcaagttttccgtagcacaaaggccatcaaaggaatgaagactgaaagaaatagagtcagttacccatataccggattgtgaaaagaacagttgttaaggagcaactacattaggtgggaaattacttttaacaaggcctctaaaaaattctctttgtttcgactttttgttgttgacgattaaggatgttgcatctttccagtacggaaaggccatcttttgcatgaaaatgttaacttctgcttttaagaaatagcaaggaggtcaaagcaatctttctacacctgctgtttttcaagtatctttaaatagtcaatataccagaatagcatattttaatcccttcaatatcttttcatacatttacctgacacctatacgttttgatgggtatctcttcacatcttttgatcatttctttaaactgggttgtttatttcttagttttaagagtttttgtacattttagataaaagtcctttatcaggtatgtgttttggaaagattttcttccagcctgttttcttttcattgtcttaactgtttgccacagaagttttaaattttaataaagttcaatttatcaattttctttcatagattatacttttagtgttatatctaaaacgtcataataaaaccaaaggtcacatagattttctcttatcttctataaaatgtatagtcttgcaatttatatttaggtccatgataaatttttagttaatttttgtgaaagatattaggtctggcaactttttttttttttaaatgtagatgttctcgtaccttttctttaaaagaaagactattctttcactattgaattacctttgttcctttgtcaaaatcaactgactatatttatacgaatctatttctggggtctctattccagtccattattttaaaattatttttattttttttccctttggccaataccacaatattttccttattgcagctttatactaagtctggaagtcagggagtgtcagatttccaacttagttcttcttcttcagtattgtgttagctattctgggtcttttgcctccccatacaaactttgaaatcattttgtcaatatccataaaataacttgctggaactctcactggggctctattgaacccatagatcaagttgggaagaaacgacaccttaatagtactgagacatgctttctatgaacatgaaatgtctattactttattagatcttctttgatttttttcaaagttttgtaggtgttttttttttttttttaaatttgagatggagtttcactcttgttgcttaggctagagtgcaatggcacgatctcggctcaccacaacctccgcttcccaggttcaagcgactctcctgtctcagcctccctagtagctgggattacaagcatgtgccaccacgcctggctaattttgtatttttagtagagacggggtttctccatgttggtcaagctggtcttgaactcccgacctcaggtgatctgcccgcctcagcctcccaaagtgcttggattacaggcatgagccaccacgcctggccttgtagttttcctcatacagatcttatatgtattttgttagattaatacctatgtatggtttttgttactaagaaaatgatacactattttaaatttccaattccaattgttcattgctggcatacaggaaaccactggctttttaaattaggtgacctcataatctaaaactttgatataattgcttaacagttccaggaggtttattttttgtccattttttttgggggggggggtggcgggcattctacacagacaatcatttcatctatgaagaaagagttttgtttattctgccccaatctttatagcttttatttttcttgtcttactgtactagccaggacttccaacacaatgttcaagaggagtagtgagagaagacacacctgcattgcttccagttttagggaaaaagcatcttgttccttaccattaagtatgatgctagctgtcgattttatgtagatgttctttatcaacttgaggaagttcccctctacccctatttggtgagaatttttctcattaatgaatgttacattttttcaaatgcattttctgcatctattggtgagttttcttctttagctcattgatgatgatagattacattaatggattttcaaatgtcgcacccagccaggatgcatagaattaaaaattattccctctccttctatttacttgaacagatttagagaattgaaattatttcttccttacatgtttgatagaatttactggtgaaaccatctgagccttgttctttctgtttttgaaggttattcattattgattcaagtattttaatagattcagattatccatttcctctagtgtgacttttggtagatggcatctatcaaggtccatttcatctaggttatcacatttgtaggcttggttgtgttaataatattcttccgttatctttttaacatccataggatcagtaacgatagtccctctttcgtttttgatatgggcaatttgtatcttctctctttttctcttggttagcttggctattgatctttttaaagactcaatcagatattggtgggtttgattttctctattaattttctgtatcaatttcattgatatctgctctagtatatattagttctttgtcttacctactccagagtccatttgctcttctttttcttgtttcctaaggttaaagattattctttttagatctttcttattttctaatataggcacttgatgctataaatttccctgtgagcactgcttttattgcatcgaacaaaactttataagttgtattttcattttgctgtttcatataagtggatcaaacagaataattttaaatgagatggttttgtttttttaaaaaaatacagaaacttctgaactttacattaaaggacttaacaaaacacacgcctggtatatctcaggtgatatttttcagtttgttctggtggtggtggattctgtacctcccaatgctggaaccatagttcaaagccacttatgacacatttcttcatcatcctctcccctgtcccccaagaacaaatgttcataagtaccaatggctaagtattactatgtggataataatgttgcatgttttgtctctgattccaaaaatgtagaaacaatgcagacccttgataaaggagaggtaagacacttcttagagtatcaggaatggagtgtcttgtttctggtttttatttttcatttataaaatatataaaagtgaagtctgaattaaaccagggatggtaatattcaccttcggtgctatctctgatggggtagttgtctataagcctgacgccgaggaggattcagaggctgggtgtttgggggaaagggtagtttgatagagaagctatgcttgctatgagagcaggaagatgaaggcacacaagcagcctatttgctgagcctgagcaaagtcactccatcttttataattctattagaagaatcattctcatttacaacatttaacagcaattgaataacaaaggtgacatgaaaataatttaccaaaaacgctatttagaaaagccaattaaatatttcttagaaaatgtcatagattaaatgtgttaatgaatgagtcaaagggggttaagcattctaaatagtttcacattgctttggaaatcagtatttctgtgatttaactggctgcatgtaaaataagaatggcatttgttatttgcaagtctttggcccataactgctttactttcaaaggttgccaaaatttactggtataattttgccaacctaataaagaataaaaatccctctcaaaataccctgaatgcaaatggaacaatggatttgttcggcagagatctttcttaaaaataaattcatagagtaaaggaaaaagtgatacatagggatcaaaacttcacaaaaacgactcacagtgttaacttgtgtgagtgtgacaggtatgcaaaatacaaactgcctgaaataggcaaaggtatcctgtctcatgcttttgtagtcactgaaactctacctgtacaagctagagacttgtaaaatggctcgagaaacaggccttcaacttatttcagttccactatgtgcctgaaattcacactccttttcaaagttttcattttcagagtaatgtttagcttggcatgagaggaaaagcagcaatttttgaaaatattttcaccactttttcttttttttttttttttttcactctttttacccaggctggagtgcagtggcatgatctcggctcactgcaacctccgcctcccgggttcaagcgattctcctgcctcagcctcacgaatagagtagctgggattacaggcgcctgccactatgcccagataagttttgtagttttagtagagacagggtttctctatgttggccaggctggtctcaaactcctgacctcaggtgataggcccgcctcagcctcgcaaagtgctgggattacaggcatgagccactgcgcctggcctcaccactcattcttaagtgaagaagtaaagttgtttcgtttttgtcgtggctttggtgttggttaattttcattttttcatgtttgcttttggttccagatcaccagtcagggattttccattctgggatatgaaagtagggcagaagaccaagcgattcacatttcaagttgagtatgaaaatcacctaggaagtagctttaaaaatgccaccaatcaggatccacatccattctttctaagttaattgaactggtgtggggactgcggcatcagtatttcttaaagggtactccaggttgctaatcaatgtcatccaaaagccatttgtcacaattttggaaagtgtctcattagggttggtggaaacattaaagaatatgagaatttaatgtttgttgctgtttctattgttttaattatctccatcacagctctgatgaagttattctactttttctactttttgcttataaaaggaatatccagaatcagataaaaaattcatgcattagaaaagagaatttaggaaaaattaattttgcctgccaccccctcaccgtcttagcacctactcctcaacgcccatagccccattaccatgtattcatcaatgacttcaactctgagacgaactcattagatattctactgccatagaaaacagaaggcttcctacaaagtgacagtatggataaatttaaagtgggatcaatagttatttgtttctgcaattttcccaaagaataacagcataaataccaataaaaattagttattacacgtggtaaaactccttcaaaacttatatctattaccccaatataggaagtcagttgattcaatcaatcacctggaacaaagagctgcatcatcctgttgtattgatcagaatgatctgttactcagaaattatacatcttattagacattagtaaacattattaaacacatgttatggttattatatgtggattagtaacatcttcttaaatttacaagtcaaaattatctcatatattttaatatggtgttgaactttgatggttgggtcaattcactctttacctaaaatcctttgaaaaaaatgaacttggccctatcaacgtgtctcttggagaaacatctttgatactaaccagatacaaacttttctaggtcagcattttggtcagataagcatctaccatctgccgatttaatttctaaagatatgttttccacttaatcaacagcagtctccccactctcaaaattaatatgatgtcaaaatgatatccattttttatctgaagttcagtactacatttggaggattttttaatgacaagcagtcctccattatttctgcaaggtttatccttttaaaaagtcaagccatcagaaagcaaggtacttacaccattttaactaaactagaagtagcattactgtgactgaaacgtacattttttttcacatcataagggttcgcatggggtgccaggtccttaagaggcccagaatacatattttgggggagaggggaagagaggaggagaaagagagattgttctaaaaaaaaaatcctgacgaaactgactcatttgttgtttataacactattcaacacgttttccttttgtaaagatacatatgcaaaatttcttatgaaggtttaatcagggaaaacactatttttgctcatgaagtgaagtttgcacatcactttgaccaccaaaaagtcaagcacctatatagcaactttaatttttatttagatcttaatcataaattcagttatgtttaccttatatgtcatattttacttttttgtcatatgtcacatgaaatctttgggatataagaaagcaaatccttttctctcgaatccagagatattatagttactcattgccatcctgactacaaatgtctacaaagctatgatacagctccccaaactaaactataatgggcatgaaactcaagtattcatgctcttatttctaaacaatgcaaagttaatttaatatgaattttcatgaatttttcatacttgagttaaattcgtaaagggcatttaaaagtaaggattttggatataaaatgttaaatgtcatataattacccagcatgttttaacagattaaaatacttccttgtctttctactgtcaaatatatatggaattccttgtgtagaagcttatcatcaaaccaaatgctttatactcagtgtgaaaattcaatcacaattgtcaaagatcaagctgctacttctgataacaaatatgatgagatatcatcttgttcaatatatgctttcaacttgacatgtaggctaataaaaaacatgaagttgtagtatttattttgtttcttccacaacagaaggctcctaagagggatgatcaaaatactcagtatcattgcaagaaaataaagtcaactctttatctgcagacagattaactggtttgccgactaactgtagtaaaagaataacagctacattgcatttgtaaaagatttaaaaattactatgcatcagtgattgtatctcaatgagaggatgtctatttattttcaacaacaaaataaacataagacactactttttgtcttatgacaagtttcattcattcaacagctatttattgagtacttactatataccaaccactgcagtaggctatcctacctcattaatcacacctagtctccctgtcaacagctctccttagaggaaggcataaggacatgaggaagagcatgcagccagtttttttgtgtcaactataattctgagatgtaaaacctaaagaggatcacagacacttttgcacgaggaaacagactgtagtacatgtgtggctgtggattaactttcccctatcttgcccctcaccctgtttttcttactttgccttccttctcagggaaagcctgaatctgccattcttgcttgcctccttctccttcagcttccaagttcataaccagcacaccttgacaactcctcagatgtccctgaatttgtgtacttccctacatccccactacattctacctcaaacccttctgccgttaccttagcttggaactccatcatctcaaaacacagtgatagctacttagtggacactcaaacctttgctaaataattgaataaggtagcttcaatcatatgccctttaagatactgaggtaaacaagagtagaataacaacaaaaaacccctgatctcattctcttttgagcaaccacttcaaacatgccagtagcaatatctcccattagttgcctaaggtagatacttaggaattatttttgacctttctctcttctctgccacccccataccatctttcctattaccttctcagtttggtttcctctgttgctctcttaggtctcacactacatgtcaaccaaacaccaaatacctcctcaatgtaaccctctaacccagcgctgtccaataactttatgcaatgatggtaatgtgccatatatatgctgccaacgggtatggacactgagcacttggcatgtggcgagtgtgactgaggaactatgtttttaattttatttaaatttcaactaatttgaattaagtagccatatatgtttcatggcaacagtactaaacagtgcagcttaaccttcttccatactgctgatagacatatcttgctacgaaacatctgatcatattacttgccttacagagtgtgactccataaaatctccatcattaggcaggatattcaaagctctttacaatctagaccaatttatcacctcagtctcattagccccactcctttcccatctagtttgcaaaggtagtaggccactcactgtactcacacatgccatgctataacccttttggaagctgctgactcctgcttagaacgccttttcctctcacagaacatctgctcatccttcaagatccagcttaaattcccatttctctctgaatatctaactgccctctcatagctgagctaggctctctgtcttaactctgctgccataacttttagtatgtggcttcattaaagcatttcatcataattaatggtttacatgtggaaaatatgagtctcatgtatgccaggtaaatattaatcacatacattaaagatagaatctaaagatagaatctggcaaagcatctggcacaggacttcactctgagtaagcccacgagagatgtgccaagtcttcaggatgtgttttaggaattgcatcgcccatgctagggatcttcaccaaatacagctgcctaagaaaacagagaggaaaataaaagaatggagatggggcaaaggaaacactcacaaggcattgatagcaatgagaggcttaggccagggaaattgtataagaaaattcatgaaagccccaatagaataagcatgcagtaaacctataggtaaagcagaacttgtttttcaccttccctaactagctggcaatagcaataatcaaattccttaatcagggagtgtggttgttacgaggtcaagaacaagaaaaaggttttcttctgatgtgtaactgagaagaatttgttgtaagcagatcaataaagccctattactatggcccactcctcaggaaagagctctgttttataaaacattgaatatatttgctgtaaggaaattcaacctatgaaagacacaggagaaaaaaaaggctctaaacttactccattttcatgtcctctagaattatatttagatagaaacacttcaaaatcaataatatccgagttgcatatatttccaatataataatttcccctttatataaaggggtcccatttttctctcctttcagtctgcttatgaaagcaatgcagagaaatatttaaatagttaaaggtaaaaatgttaatggcaatcctaagcaatattcaatatatatacaggtatctgaactgagtaagtacgagtcagtattaataatattttgacgttccatttcattggtttgagaaagcataggtttatgatataattttgttattaaataaaatccttgaattggatttgcagattgaagaaaattaatatttggatttagttcagaggttgagtaaattagctcagttcactctgggtttgagttcatggttcagttcaagttcttgataatgagcacatcaaaataaaaaaatatttaaataatgcaatcagggctgacatttaagagcaagtgttcaggcaaatatgtgtttttaaaaaaacaaactcactttacagagagagctaaggttaaatccgaaggtttgagcattccgggagccagcattcatgtagtttcccattagcaatacaagttccagcaacttgctaaagcttttgctcttctttatctcttcgcaggcagtactgacagccatgatgtcaggtttgatgttgttcacctgctcttcaaactgaagcttaaagagaatagcactgagccgtggccgtagtctcttcacattgctcatctgattgaaaagaaaacagcagatttcctttaaaatgcatggtatagtttagtactgtacgactgcaagtaatctgggatgatttattggtatgacagtaccaaagaagaaatatgtctcctaaaactgatagcaggaagagagaaaagccctgcttgtttttgtaaggaatccagagtcatccctcaaaacccaaattaacaatttagatgctcaatgaaaagaaagctttaattaaatgataatgtttaattaagcaataaagtaagcattttttaaactaaattctaaaaaggtaacaagatacataggccacaaattacaaggcattcatgtcattattttgaataatttttgttcaatactgcaatatactgggtcatgtttaaaacacattcagaaaagtctaaagagggtttgttttcttcaaatagcaattgctgtcctcagaaaccctgctgactaacagtatgtgttagatagagggagagtaaataggtcccaatttgtactaaattgactttcttcagaaacacaggaaagtagaatgactcctgacacatactaaattagcagaatcagagttaggaaacatgggagtagtagcaggcagaagcggtgcaaacccacaaatctatcacatgccaagttaaccctgtctgggactctaggtttctctactgggaatgtgggggactggaggtgtctaaaagaacaaaggggcaagttcctgcctttatccttactcctgtgttatatcaacacacatgcaggaaataatcacttagctgtaggctgaagacataccacatatgaagctagatatgaattccttgaccaaacacactagggatttgggacttaaaacgcactgaaggggcggtaatagtaaaattgttgaacttcaacaactattgtaaatatcaaaagcaggttaaggcaaggtcagaaaaaaagcagtgacagattaaaatagggactgtttctcccttagtcacagactgtaaaggaaaggctaaaaaacaatgctatatgaagcctgtaggatgccaaatataatgaaaatcatgattgtttgggatacagaaagctatcagctcataatataataatgaccgttacttaaaatatactagacaaaggcttataagactccaatatattatagacactgccttaatgactaaacataactcagcttactcatctgacaaaaattgagcaataaagaattagttctttgtacacaactctgagagaatattttcatatagaccaaagccctatagtgaatgaaaagttccattttcaaataatataaatatctaatttatacttagctttctccccagacccttgccaaattaaatggttattcatatacaatcaagattctaagggctcaattaatgtagttattaataagaagtctactttacaaggcactttaaggaacgtcttcatattccactgtctaggaaaaacaaagaatgtaagttcaacaaggaccaaaaaaaaaaaaaaaaaaagaagaagaagaaatatcattaagtttatagagtaagtttaagcgatatgaaattataaagagacaaagatgtactattataatgttgattcttattgggcatgaattgttctttttaagcagtgatcacttatcacaaagacatttgtcttaaaatatattatattttaagacagatgggttcacttacctggattttttttatccttaaccattgcaaaaggaagatgttcatatgacactggtaacatgaataatgctctattacacttaatatgtcctttagagcagtcagacatacaaaagagcactcacatgtagtacctgtagttatggccattctgaaggtgtataatgggctcatagcatcgctgttttcagtaagtgccattattcatgattatgaagccaggtacttgcaatacatatgagaagaaattctccagtattctatgcaaaacatttgtattacgaaatatattaattctaacatatattaatgtactactacattcatgcacagaagaaaaaagagactgcttaaatgcctacattataccaccccaaaatatgttaaagctttcctgctgacaagctaaccatatgtagccagcatagagtaattaattctcctagaaaaatataacctagatttgtatgaataatgagtgtatctggcactagggacaggtaccttgaaaagatagagtaagtctatgatgtaatgcagaacaaagtgctacaagttcatgaaaatccctgacaaggcaaagtcaggaaatgtaacctaaaaacaaagctttgaacaacacttaaaaaaaaaattagatgtccttttcctattgttctttcttccaagtttagataaatcagtatttgactattattgagtaaatgtgttttaataaataaaattattgagtgggaaaagaacttgaaaggtcacctggagaaggtgcctgtctttagttcactatttagtcatatgatgacccctaggccaaatggttgccctttttatttaacaacaaaatatcatttaaggttaatgttccaagatctaaatcatggaatctatgataataacagaagggttacttttctttttttgaggcagagtctcactctgtcacccaggctggagtgcagtggcacaatctcagctcactgcaacctctacctcctgggttcaagcaattctcctgcctcggcctcttgagtggctgggattacagccatgagccaccacgcccggctaattttttgtatttttagtagagacagtgtttcaccatgttgttcaggctggtctctaacttctgacctcaagtgatccacccacttgggcttcccaaagtgctgggattacaagcatgagccactgcgcccagcccttttcctcattatttgaatcaaactttatttcttcaggtggaatcaaataaaaagggttaagaagggggaaaatatatgtatatgtaaaaagcccgaccaatgtttccgcatcctcaccacttctcatattctatcaacactggggatttgcattctgttttcctgctaagaaaactaaacttctgacttgtctaagactaagtggaaggcagaaatgaactatggtgctcaaataatactctgaatggcaacagaaagtcatttttaaaaatgagaaaaaggaaagggtaaatgaacaataaacataaaatgtaagctagttaataattagaatgctagaagaaattagaatttcatttttacagttatcctttaaatctattgttacaaagtcttggcaatataaattcacgaaacccaaatctgacaataatgagatgtaatctgaagatcaatccaaaaaaggaaaaatacattgatttcactcctgtttttcctgaaggcagggagcagtactcctgtaacccccccacacacagatgtcatatgtcagaatgaagagatgttaaaagcagtgactggtaaaaatcaagaagcaatatccagaaccctaagggtaattttatttcaaaattttgtttgttggcaatatatgttgttagagagggaacaacgtaaaaagacctttagaaaaatcaatgaactaacaagtattgactgggccccattcagtgctgtgaggggcacaggagccatagcagctgcccctgtagcccttatcgttgaattctttctgcctgtcttaaggagtataaagtcagaaaggtccccaggaagatgtaatctctcaaaatctcattatggttctatttttcacatataattttatccattattctataaggaaaaaaatcattttttacatcaactttgtttaacaccatatctacttctctttatacattttcttttataaatacaggttgtcagatgtttttttcccccgtcctactatgcagacttaacatggcacacctcagaaggatttattttttattcttttttattcttccctgaagttattatgaaacttcactgttcacttaactctctaacagtatagtaacctgctgactgggaagttactggcctcggtcttaatttataatactctaaaagcattagttcatctactttgtagatatcacattataagaaataacagaaaagcatttcaggaaggtgaaatgactctttcaagtcacctggctagtaggacccaggcctagagctaacttgctgctaatcaactgtccttaccactcagagcatcgcaatgtggaaattaagaaccacaatttacaaaccatctggaactcaagcttcctctgctatgttttctagtaggtaagaatgaactttaatttcttcacagtagttatcaagtaacaccctgcaatgagctctgcctgccacctgtactatctcaatatttcttaccttcctccttaatatacccaactacctcctattgtgctgaatctttaatactttttcagatctacttttgttgtctctccacatcagggatcccacaccagtaactgttagaaaacaggctgcatagtaggaggtgagcagcgggcctgagcgagcaggtgaagcttcatctgtatttatagctgctccctattgcttgcattaccacctgagcttgacctcctgtgagatcagtagtgacattagattctcataggagcgagaaccctgttgtgaactatgcacgcaaaagatctaggttgcatgctccttatgagaatctaatgcctggatgatctgtcgctgtctcctatcaccctcagatgggtccatttagttgcaggaaaacaagctcagggctcccactgattctacattatggtgagttgtataattatttcattatatagtacaatgtaataatagaaataaatgcacaataaatgtaatatggttgaatcatcccaaaaccatccccctgccatctatgaaaaaagtgtcttccatgaaaccattcactggtgctaaaaaggttgaggactgctgctccacactacactctccactcatactctcctattagctaattcttcagttctctatgggagaggtatgataagcaagaagaatgtgaaaaaacaaatgcagttttatgaaagacaagagaaaatactttgagaaagtaatgtgatctaatacatcacagaattaagacactagagaaaaaatttttgagcttgatttttctaatgatataaaaaatatctttcattgttaacagaccaatatgttcatgatctccagaattctcagaaaaaaacacaagttcatttcacttggagaaaggcttcaaaaaaaaaaaaaaagctattcaagtgacttatgcctgaggtaatactcagaatatcaaaactgtttttaaaataaatgtactcttacgatattaaagctgctatgctaaagttatttaagaaaactatacaaaaacaaagtacatatggtataatttttacatatttcataggagaaaggtaaagccaaggcttgtacaaaaatattaaaaggctaaaatgtatattcctccacttagtcaagaaataaacaattggctatagacattagagactgctgcacctttgtttataaatccttatcaattctggatcactaaggatttcacaggaggtccaaatgagttctgaagatactcaggatcatcaagtggtaaagctatgattggtaaagctaaagaacaaagagacttcctatttaatttggcagtctcagcacacagtcttaacacataagtttcatatctcttgaattaaaaagctggcataaaccccagaatcatattagtgtcttaaattcattcatgcccgcttccagacaatccccatcccatcgtagaaaaccagtgttttgatttcaatcactatagcttagttttgcctgttcttgaaatttatattaatgaaactatacggtaaacagtttatatagctggcttctttcactaaaaaaaaaaaaaaaaaaaaaagactgagatttatacacacgttgtataattcagtactttgttcctttttattaatagatttccatgcaagaatataccaaaatttgtgtatctactttcctgctgatggactttccccccaacccaccccagtttggagctatgtagtgagttgaattgaacagagacccacaaaaggtatgtctaaatcctaacctctgctaccttgaatgtgatcatatttggaaacagttttagcatacgtaattaaattaagaatctcaagatgaaatcatcctggatttagggtgagccctagactggagtgatacatctacccagaaacgccaaggatcgtgagtagattaatgaagctagcagagtggtatggatcagattctcactcagagactctggaagaaaggaaccctaccaatgccttcatttatgacttctggaccccagaaatgtgatagcataaatctctgttgttttaagccaccaagatcgtagacatttgtggcggcaaccctaagaaactaatacaggctattttaatactttcgtatgagtgttttcatttctattaaattagtaaaaaatatagtacaaatgtatacctaacctaaaacattgccaaagtgtttttgcaaagtaggttatatgattttatattccttttaccaacttatgttttattctagttatcttttatcttttcatgtttaggtccgtactccattcctctaattattcagtaaggtgtgatgcaggagttgagattcattttagtccctaagatgtatagactttacaaaactatttgatacaaagaacatcattgaatatcaaatgatggtatttttgtgggtctatttctaaccttctagaaagcttagttgtatatccttaagccaaaacttttgccttgatgttaaatcagtagtttaggtccaccaagtttgttgttctttaaaattggttttctatattctatgtcctttgcataccatatgaattttagaaatcatttgtcaatttctataataaaacctgctgagattttgattgggaatgtgtgaaattcctaggtcatgtgagggagaaatgaaatcttaacaataccaactcttccagtctataagcataataaataccatttctttacaacttctttcatttctctcagcaatatcttacagttttcagtagaaaatctgcacatatttagtgaaatgtatcccaaagtatttttagttttttttatgacattgtaaataatactattttaattacatttaaatttttgctgtttgtagaaaaaaataactatttttggtacactgactgtattctatgacctttttcaattcacatagacaattaggtcagctgaaaaaaagaaaaagatggtatactttctttcctctaatgtattcatcttttatgttttcttgttacacagactagtacattataatgctgaaaggaagtaatgcaaatagacacctttaccaggttctcaaccataaaagacaagtcatctaatcattcacccttaagttgagtataactccaggtttctcatggatgtcctttatcaaaatgaggaagtttccttctatttctagtttgttgagttttttcataaaaaatgactgaattctgtcaaatgcgtcttatttcgcatgtatttaggtaattatgatttttctcataattaccttgtatttttttatctgataatatggctaactaattaattttgaaatgtaaaaccaaccctgcattcctgggatcaattccatgtggtcataacatactctccttattaagttcagcaatatttgatgcaaaaatattttgttgacaacttttgcatctatgttcatatatgatattagtttctagttttgctgtagtagattcccttctttgattcctgataccagtagtttgagaatttggttgtctttttcagcgcttcattttcatttggctcaaaataattccttctttggcccaccggtaattttaaattaggttatgcaatttttagactgtggtagatgttctattattgttgttgtctaacttaattctgttatagacagaaaacataccctgcaagatatctatattttgaaaattactgaggcttattttatattcccatatggtctaccttggtaaacatttgatatgcgtttaaaaataatgtgtattttgcagttgttgtagatagtgttctataaatatcagaacaagttggatgatagaagtatcttgattttctaagaatttactgattttttttgtacactttttctagaatttattcaaagaggagtgttaaagtctcattatgattgagaatttgtatatttttccatttttttctgccaggttttgcttcataaattttgatgctcaatttttaggcatacatatttaaaatgattatctcttcctggcaagttattatttttgttattgtatactgatacttcatttcttataatatagtttgccttgaaagataccttcttggaaatacacatacccatgatatttttcatgtgctattttattactatttgttttccatatgtcctttctgcctttttccccactgctatgtttgagtgtttgtgtcccaccaaacataaatgttgagaacttactcaccagtgtgataggattatgacatggggcctttgggggtgattggatcatgagggcagagtcctcatgaatgggattagcaccctcataaaagagggtccagagagctgccttgtccctccaccatctcagaacacagatagaaggcaacatatatgaatcagaaataagtgggccctcaccagaaatggagtcggccagcaccctgatcatggaagtcccggcttccagaactgtgaaaaataaatttcagttgtttataatccattcagtttacagtattttgttacagcagccaaaatagaccaagacaacctcttttatcccttttctgctttgtgttagtcaagcaatttttagtattctatttcgtctactggcttaactatgcctctttttatattttctctggtttgtctaggattaatacatcttaatgtatcaatctaattggaattataaaccctgttacgcaatgttttttattacaaattttctttcaaaaaatcataagaaaaaaggttttatttactatttcaggtactcttcattactttttgtagatctgagtttccatctggcatatttcccttttgcctgaaggacaacttttagcatttcttgtagggtaggaattactgtcacaaactctttcagcttttataatactaaaaatgtcttcatgtcaccttatttttttttaagacatccattagatagagaattctgagtttacagggtatttttttaacacctttctgttgagcttcttgcattttaaactcttctgttgacttctgctgtctattacttctatgaagccagcaaaatcttttatctttgttttcctacatgtactgtgccttttatctttttcctcccctcaagatacttttatcattttctctttttctttggttttccacagttttactaggctgtgccatgatatctttttctctttatatttttcctagttgggatctgctgagcctcttaaaccctaagtttatgtttttcactgaatgagacttttttgtccattatttcttcaaatattttgtcagccacaatcttactctcttatcctttggggactccagttacaggtattttagactgaatgatatctacccaataatacctgctgtttattactttattcagtctttcttcctacataactaagagaaaataatcactataaaactgccttcgaatttcactgactcctctgccatctccaatatactattaaacccacatactaaaatttttaatttagttattgaacttttcaataatttctatatagcaattttttttatagttttcatttccctgcaaatattccttaattatgaccatgtttttctttaattctttgaagatcatttgctttagttctttgaacatatttgtagtatccttattttgtctttgcaagtgaaatccaaaacctgggccattttggacttctttttttcttgataatacatcccattttattattctttaatttttaattcaatattgcattcaatattgaatacttacttacatataaccactctcagttctgtaatatcccattgaaaactatttgttcttatttgagcagtcaaatcaatcactgggtgatcatcttaagttgtatagttcactataaactttgttagtgtagctctctggaaagtaagatttgttttcttagaccctctaacttagtgaaactcaatctccaacctgttttccctggggagttcatcaagacgtgctataggttttattagggtgggtctagactaggtctttagggtgtggccctacttcctaaagcaccagcttttccttatttgattgaatgtcaaatatgctaatgaagtgttaagatgatctctgtaatttggcagagccagaagtacaaagctgaacctctagtatctctgttccactctcaccctgtagcagctgctatctggctagtcttgctcagtgtatgaacactccagctcccaggcacagacacaagggagatacccacgtggactactggagttcctttctgcacaattccttccccattagtgctctgccctgtagataccagctgtttcactgccataaattctgatctttgcctcctcagctcagagaactatattctctgctagaactcaaatctctgtaatttaagtggaaaactgtcaccaagccaaaggctgagtattcatgaaacttttaagtttctgttctctcaagaactgcagcttttctctactggctgctcactgtctgaaaacagttgacctggatattttgtccagttttatcaccgttagcagtttatatatgttttgttatatgtattcctaagcattttttaagttttctgatgttgatgtcaacgtaatttttacaactttttactataatttccgtttttaaaatacaaaaaaaaaaatcctgtacccaaattaaacatgctgtccacatactgcttcacttaattcatcatattctttctctcttcttctccacatatatacatatatgtatgtatatatgtatgtatgtataaggtgctctccacaagtttttccaatgttaaattactgtttctttcctttataattaatagtttatggggagctgtttcgaggctatgtaaatagtatgtatataacctattttcaccaaattttcacatttgtatcaacagagatagcacactaactagaaaaatacagaatctactcaactttattaaaactgaactttacggaccctttcagaaacagcagtaccttcaagagcatgacataaaagtgcaaatgaaccagaatatatctacaataatttcactttaagccacaactgcaacaaaattgtctaacttcagtgatttagttccataagtccagcctcctcttttccattatgtttccaaaatagtcttacaagagtataggtaaagcaaatctcaaacctcataatgagatttgaagagtacagaaaaatgattcctaggcactagatgaaagtcagatctaaaagcaaccttaaaacaatgttgtttgcaaagtgatgaatcacaagagacctttttgcttataactacaaaatgctttaggctgtatttcaaatgaatgatgcatggctggtaattagtatgtgactataatgatgttttgttttgtttttccaaatgaaagaaattaagcagattgtgccataaaatttcaacactacatagatggtctaactagaaagcatcatgtttccataccaaaaaaaccccaaaaattatcatcaaaaaaaaaaaacaatctacaattctatgataaaataaaatgcccccactttttagcaggaatttagtggggaagtggggattttagattttaaatcccatataagaaaaagcagaaactaagaaaattttgaaaaacgtactttgaattagccatcaattcaagttcctgcttaaatattctaggtaattttttacctcgaagttaatcttcagctattaaaaataaattgcagaagcatttaaacagggaaaccactgctaaaagcaactttaagtacagtaggtacctatagcaaacagaaacacaagagtgattgccaccataagaaatgaagtatggccttagtgtcaaaaaagcatggttcatagctgagctgtaatagttaccggttgagtaaacaggtcaaaaagttgcctaatctatgtgatggtaatgcctatttctgcagttatatgaaaatgagacttaactttactcattcattgtgtatcaaatatttattgaacccttatttatgtgtcaaacactgatttaggacctgaagattcatattaaacaaacaaacaaacaagcaacaacaacaacaacaaaacaagaacctggtgcacatggaatataccataagtaagcagagggagaaggggagaaaaagagatagaaaaacaacaaacaaatcagatcattttaaacaaaaataaacgctataaataaatgaaaaagagggtaacatagatagagaatgatggggggcagcatcattataatgaaaacttctataaggaagtggcatttgggcccaagaggaaacagcaagaggaaaacctaaaatgagaacaagaaaatgtatatagctcaaacagtggaaaaggacaagggtagtaaaagttgggattaaagaaacagagactacattatcttataaattatcatgaaactggaaaccattagaagggtcaaagaaaaaactgaaagaattcattggcactaaaagaaatgttaaaagcatttcttcaggaagaaaggaagtgatttcagatagaagtctagatttataaaatgatgtgaataacactggaaatggtatataggtaagtagatataaaagactctttttaaaaaataaaaagacttaaaatttctttcaaaaagaaatactccaagtcctaaagcaccaataatatagcaaaacaaagaataagagtgaataagtcaaaaaagataacacagactcattaaaaatactcaatccaaaagaaggtagaaaaagagtagcaaagaatagatgagataaatagaaaataaatagtaagatgctagatttaaaccctgccatatgaataaccagattaaattaaaatggtctaaacacttcaattaaaaggcagaaatggtcagactggattaaaaagcaaaactcaatagactgcctataaaaactgtaggttaaaagataaaggatagaaaaaggcatagcatgcaatcactaatcaaaataaagctgaagtggctatattaagataacacaaagtaagtttcagaaaccattagagtatttgaagtttgtgaacgacataaaatctcatttaataacaagagtcagtagctgctatgtgaaaatagtatattcaaaacatgaagcacaggtcctgaaacagtaaataacaaatggcaaatacaaaaatacatatggtatgatgaaccgccatagcatcagcatctctaacattacatcttttctcaacaatattgttctaagattaataaccatattttattctactttaaatgtggctttccattgccatttcattaacatttatgaaacaaacacactataagcatggcaacccctgccgtactttcagaattttatttaacaaaagagggattatgagaattcattaaaatactataaatgtgatacttacattctagagtcacttggctaaatcctctgaacttgcaagtggttaattaactacatgttcaagattgatcagtggaccaggtaaaggtcagttagtcacagagtaaaagggaaagctggagctggggaggtaggatccaaacaaaacacaatgcagtcagatccctgaatgcaattccagccagctaatggttttatatctatctttaaaagcagacataaccagtagacattaaagttcttggtggtcttctagggaggcagggtcaggggtagagatacagacagtgtgacacaggaaaaagccctctatgttgcagattagtttattcaaaaataatgaacaagagaacctttttctatgatatttgctaaccagctcatatttcgaacaataactctgcccacatactcttaaatgactaattccttgccttaagtttaatctatgcgattttacaattcttgttttttgctgatgccaggatattaatgacaaaagtgtttctctatattccaaacataaacccattaagaacgacagcttgctgtgtttcttagtattgattgtatgcaatttttattctttgtttctacgttaggacaagtaaaattcattcagggacttctaaaaataaattggtagcctttcaataattcatctggtatttgggttatgctttatttcaagccattgatttggtgggtgcattttgggagcattcagatcaaatcactgtgatacattttttttcaggcaactcctctgcccttcagtaataaagtatacccgttgctattgtctgaggatatcagaagggccaggtctgtgatctgcaatttaagcagaatgggagatactaaaatgtgggaagacaaaggaaaacctactgaagatgggacatcaggtggcattcaggtaacggacataataaaggatgaggctataattaaggctcgtgggcataaaaaaaataggcagaaacctgcgttttaggaagtacaggttgaggaaacagtggtctctaactgctaagagagatcattaatgaggccagcagtcaaaatcatggataattccaaaggaagtggtaataagaattcagtaagaagtagctaagaccacagcagacatagtccttcccaggagaaaaaaaaaagaaagagagaagaaaaggaaagaagtctcccctgcccccccacccctcaaaagcacataaatagaatgagaatagaacagacaattgagcagtaaagaaaaagattgtcatgaagctaattgaactagttttctcttaattacattaaaaatatgaaatgtttttggaaattctgggtcagaacttaggaaaaacaaatacagtgtcaaggaaacttataacaatattaagctgctggaaccttaaatcttttcagaaaatactagcattcaagtgatcagaatgatttaggcactttactgtggctagtgattccaaggagagctacttaaaaaggaaacattgataaaatagggtagaaagactccatttgtccaaaacataaaacttcagtaatgccacatagcttaccataagaagatgacacataatgctacaacaaggaacaaaatattgacagaataaaaactgacctaatgacagtttcagcataaagccacaaactgagaacccttaaacaaattaaaatttatattactaagttttgactatttaatgcataaatgtaagtcaatatactgtaagtgggacagtataaacacaaaaaaaggaatttcctaacatataacaatttgaacaaattcctagattttccttggacaaatatagtaaatcaaattatttggtagtggtgatgctggtggcatataagttagtgctagtgtttcactaaacgggaaaaaatcactttggctattcggtatccgctcttctaaataactgtaatatctagacttggatataaaattggcatccttggaaaagaaagaaaaatagcagtaatggaaaatagcagacttgcaggataggaaacttgatccaatgttaaaggaaaaaaaaaaaaacaaaaaaaaaacacatttatcttgtgaaaagagccaagtctggtatggaagacaaggatgtttaatgacgcatataatttaatacaaaataaaaatataagaaaagcgaaaaagggaagaaaaatcaactcagacaaagactataattaaccaaatacatatggggccaaaacactaccaccctttgtctcaggagccacaacgtgaatgaagttaaataaaactgtttaaaagttgattctgagtatctcagagaaattttcaagtgcttggcctcagattgccagtttccctgttaagctgaggacagaaaatggagaaaggcctactcaagagaagtcagtggtcaggccacaagaataatgagccagacgaggtagtcgacattctagaagtgtacacattcactgggctctttaaggatggacaggggaatcctctcccatttgggtcttttatttctgaagacagaaaatagggacaagattgatcctaaacaaaaacgtaaggtaaactctatttttaaaaacctttccctttgcattcatttacctttttcccacctcctgtgtgcatctaattctttgccaatatatcaagaactctgtgcctaaaaacaacacagtgtggtggaaacaaaatgaaatatggaaatgtaagtttagaaatccgcagtttcaatctttctcttttgcttatggcatgtggaggaggtcttggttaagtagtctattctatatgagtttctgttcttataaccctgaggagctattataaacaatatgtcatatacatgtatataaacatactttgtgaactgtaagtcactaaataaacttcatataactgctatgtaattacttgtctgctctatagtggctcatttgatgcgatattatgccattaacctgaaactccaaaattcacctctctccccgctccctttatccaaaccatcatcttttgagtatcacaagtcacagataccatattttaaaagttaatcagactaaaggaatgcagagtaagattttaatctcctctaggtatcctaaagcattatatgatttacaaacagaaggctgacctgatgttttataatatctcaggtagttacatgaactgcagtatttttggtgggggaggcgggggtggaggcaggggggtcggtccttgaacatacttccgtaacaactattaggctgttattatacacaactcgttgattttaatttcaggggattccgagaaatccgggatacctagtcagagagttagaggtagaaagcttttaaaggctcatatttctagccccaacatgtgcaactaatatcagaagagaagcttattctaattacttttttagtaatttagattatactcttgaaacccactgtgttgaaaagaaaataaataacccagcactgtgtctcaatatgagatctggaagtcacaataattgatcacactgaaatgctcatcagttagtatctacctttatgtcaacccctatatggcatcccctttgctacttttcactgcaatcaattgtgtctacttgaaagccaaagtatagaaagtctggaaggtaaaaattgctcaaaaagagttattaaaaaaattatatgtgttttataaaatcattgagaaagaagagggtatcaaaagaagagagtagaggagagcatctgagtaagattcttattcaagtgttagaagatatgggaaaagagtcagggaggagtcagacattagaagcacaagggagccaggaaagagaacaaaaagtagatataattaatagggtgaaatgctgaccagaggtcaagaccacacaaaatgagaaatgaaaggacctaagctgaatctggaattatgaggttgtctatatcacaaagagaataactctacgacagtgatgggaacaaaagcatatacataaaacatgctaaagaatcgtagaatagtgagagagaaaattcttaatgtaaagtggaatatagttcttaaggaaagtgggtgctggccgggcacggtggctcacgcctgtaatcccagcactttgggaggccgaggggggcggatcacaaggtcaggagttcgagaccagcctggctaacatggtaaaaccccgtctctactaaaaatccaaaaattagctaggcatggtggcgtgcacctgtaattgcagctactcgtgaggctgaggcaagagaatcgtttgaacccagggggcggaggttacagtgagccaagatcacgccattgcactccagcctgggcaacagggtaagactccatctcaaaaaaaacaaaaaaagaataagaaaaaaaaagaaagtgggtgctgaactggatcacaatagatgagaagaaaaaagtgtaaaataaaaataagagaatgaaggctgggcgtggtggctcacgcctgtaattccagcactttgggaaaccgaggcaggtagatcacttgaagtcaggagttcgagaccagcctggccaacatgttgaaactccatctctactaaaaatagaaaaaaattagccaggcatggtggcacatgcctgtaatcctagttactcgggaggctgaggcaggagaatcatttgaacctggggaggcagaggctgcagtgagctgagattgcaccactgaactccagcctgggtgacagagtgagactctgcctcaaaaaaaaaaaaaaaaaaaaaagaaaaagaaaaaagaaaaaaaaagagaatgataacagcagctaacataattgggcatttgctatccactatacactacacacatgcatgctctcctaatctcaccacagctctgtgagacaggttctatattcacgtatattttaacaaacaaaggaaatgaaattgaaagatagtaagaaactcatacaacgtttcataactagatgtggtaaattcagaattcaaacccaggtcttcacaatcagattagaaacacaaggaaggacagttgaaggtttctggaatactaagacaaagttttttttaacccagattcaagtctcagtactaagaacatattgccaggcaagcctcaataagccaagagctaaatgattttagtttttcatatttaaaataaataaagcatctgagagaaatttacttattcattcatcaatatttattgtataataccatatattgtttgaggcattaggaattcacaagtgagtacctgacagaatgattcctgccaccatagatacttatggcaggctaactaggttagtggacagagcgtaatacagtaaatgagaagccgatgagtactagggagaaaaataatgcagtgaagaggtgtaatggttaatattgagtgtcaacttgtttggattgaaggatgcaaagtattgttcctgggtatgtcttgagggtgttgccaaaggagaagattaacatttgagtaggtggactaggagaggcagacccaccttcaatctgggtgggcacaatctgatcagctgctagcatggctaggataaaagtaggcagaggaacatggaaggactagactgacttaagtctcctggcctccatctttctcccatgctggatgcttcctgccctcgaacatcagactccaagttcttcagcttttggactcttggactgcaccagaggtttgccaggggctctcaggcttcggtcacagactaaaggctgcagtgccagcttccctactttcgaggctttgggactcctactggcttccttgctcttcagcttgcagatagcctattgtgggacctcaccttgtgatcctgtgagtcaaaactgcttaataaactccctttcatatatacatctatcctatcactcctgtgcctctagagaaccctgactaatacaagaggaaaagaagtattttgagcaactgattatgcaatttcaaagaaggtgcattgagaagacttccacaaaggacctgtgaaaaaagaccagaaagaaatgagagaacaagccatttgaataactggacaaggcaaggtacaagtgagaaattctcaagaatgtgactggcatgtttaggaaacagtatagaagccatatgattaaagttgccttagccagggggaatggtagaagatgaggtaagaaataccaaggcagggacaaattatgtagagccttgtagactactacaagaattctggactttcctctgaggtgggaagtcattgtagggttataggtaaaacagaacattatgtgactgaagtcgttggctgttgtgttaagaatagactgtgttaaatataacttgagatgctatatcaaattctttcacaaattttacatgcacgtgatataaaacacaagcaaaattttgtaccttttgccatcaattaaaaagaagagagatcaatataagtcacagttgaaatttcaaactttttgagaaactcacaagttattagcagctcaaggaaatagcatattattctgatcatgctgggtttttattagttctaataaattaaagaattgcagagttatttaatatagctgacattctactaatttcaagggaaaaagagtaacaaaagctcataagagaattcattcagagctcaattccacttatcctcccactctacagagaacacaattggcagcatgtgagtgattttttccctgtaatggcaggatttgatattactattttgatggagatttgaactaaataagctcaatcccttgattaaatgagagttattttataaaggaatatgcctgcacacttctggcattttaactttatcttagttcataatacaggaactatatatttattatcatgatgtattagagattattccattttcttccatatgagagcaaggtctggaggcaaaaagttttttttctttcactgcacagacacacgttgtcatggccactagcttctttctaaatgtccctgatgaattatataccctacaaatgccaaatatccctctcaccccaactcatggttagtttttgaaacaaactgcaatagtgttatatataaaatcaccttgtacaattccctaggtaagggattgcaattgtcctttgagaggtgataaccagcagcaaaaacaaacaaaaccttgctgatgatgtgcccctctccagggagaagactgagaaaaacagtaaggtttgcatatttcaccttgcccttcactgcctcttgtgttacatttctaattcactccctcagtgatttcatccactcctatagctttgtatgtgacctgtatgctattggcttccaaatttataactccatccctgaactcccagcttatacccccaaatgcatgcttcatatgtccactaagaggtcaacagacccttagttatcttcccttccataatctgcttctcttgcagactttccctcatctctataaatgggaactcttatctaattttacagcctaagaacctggagttattcatgattcctcctatgccccaaatccaatctgtcagaaactctaattcactattttcaaaatcatccagaatctacttctcaccaatgacactgctgctaagcctgtcaaactaccactaattcacacattaataatgagatcattgaaatagcttgttaaccagtcactggctttaattatattcctcacctcaccctactatctgtttctccatatagctgccagcataacacttctatggcatcagtctgatcatttcacccctttgttaataactcactaacggctttcttaaaataaaatccataattctcacactatggctgcaaggccatgcatgatcaaggccctggtggcctctttacaccgtctcccaccttcactctgccacagccactggcctcacatagccaaactcacttatccctcaaggccttgctgtttgtggtctcttctgtctataacatgcttccttgagatatccacacctctaactaaagtcactccggcttctgctcaactcttacctcttcagaaagtccttcctaaccacacaaattgcacacacaaacacactcatcctaccacttcctgcagagcattcactactatctgatattacattattatttatgcatatattgctaccatccccaataaaaatatatgacaaatagggactaagagaaggatcatcacatttaactcagagtctgcagcaatacctagcacacagtaggtgttcaataaatatttgtcaaaaaatgaataaattattgctgaatcaaggagacaaagtatttgaagaaaatttatcagacaatggtacagtctaccaatacaaactcaaagtctaagtttctccaacaaaatccaagtccctgaaacatccaaagactgaaacatacactactggaatagttgctaccaggaggcattccccaggctgaagtgcagtggcacgatcttggctcactgcaccctctgcctccccagttcatgcgattctcatgcctcagccacccgaatcatctaatgagagtgcaaataaaaatgtacaaagttcttaagtatacccaacctatcagcagtaaaagcaatgttaagtttcaccattaaaaagcctctaattttccatgaatgtcactatatttggttaaatcaatgaatcagttacacattattttgactgttaaacatgtaaagaaaaactgtgtatggttgatatggtttggatttgagcccccatccaaatctcaagtcaaattgcaatccccagtgttagaggtgaggcctggtgggagatgactggatcatgggggtggatttccccctttggtgctgttcttgtgataagagttctcaggagatctggctgtttaaaagtgtgttgcacccccctcccaccttactccttctctggccatgtaagacgtgcctgtttcccctacaccttccaccatgatcataagtctcctgaggctttcccagaggctgatgttgccatgcttcctgtaaggctcgcagaactgtcagccaattaaacttgttttcttcataaattacccagtgtcaggtgtttctttatagtcctagcactttgggaggccaaggcaggcagatcccttgaggtcaggagttcaagacaagcctggccaacatggtgaaaccccatctctactaaaaattcaataaatttagccaagcatggtggcgcacacctgtaatcctagctactcgggtggctgaggcatgagaatcgcatgaactggggaggcacatggtgcagtgagccaagattgtgccactgtacttcagcctgggcaatgaagtgaaactgtctccaaaaaataaaagtaaaaataaagtgacaagaaaaacaatgactgaatgcttatcttaaaagatgcatacctctaagatttaaaatagctagaaatatagttatgaaataatagtttattatttcaaaccaatgttctcactgtgtaatgaaagatttccagacaagattaccaaatggccatctaaagcaccatagaacttgagggaccttggacaactggacaaagcagtagcagtggatgaatggaacttctcttttccaggaagagaagacagtagattctgccaacttcagactgacacaacttatgtaattgacagacgagatcaaagatgaattattaaacagaaaaggaagtagtaattacaagaaaccaaaatgggttcttgaaaaaaattatatcagagtaactgtatgtctttgttaggagactgaactctgggaaacatgattgattttgtatctggacatttgcaaagctttgaaatattcaacacctaaggaatgcaagaaagacttggagatatttagtctgggaaagtgttggtttggtggagatatcctttcagtttcctcacctatcttggtcaatgttttttataagtgtttcagtaagccatgattcttataccaaatcacaatttcctcaacatcttttatgaaataaaaccactaagtactaaaacaagtattgtatagagtaccatgagtagtcacactcaaaacaacatggccttctgagttaaaaatcaggaaaacgttcaatctaagatgttgtactagacaaacctagaagttaaatggcaagatcacttagggtttaagttctattctttaaaaaaaaaaaaaaagtgtgaattatgcaccaagttattgatttcttggtctacttttgaattaacccattttcactcatagagaaatcatctacagattcatttttaacaaaaaaatcaaaaatactcaaaatgatttttaaaaacactgttttcattttattgttcttgctatactttttccatcctttctgttcatctattctttatttcatacattcacttaacatacatgtatatgttatgtggcactatgtgtcagtagatgtgccatgtgctgggaatagaaagatgagcacaatacactctagcctgtcaaaaagttcagagcataaatgaagactgtgacttgtaaaataacacttatattccagtataatacaagccatttagagatatgcacagagttctctggtaacaaagaggaaagatactgaattttgtatagaatgaagtgttagggaaagctccccaaagaggcttcctcaaaggggaaagaagggaaaggcagaatattgacaggcttgagcatgatgctttcagagctcaacaaattgtctagcaatgatgaggcagagagaaaaaaagtaagataggaggtagaaggggaatgttaggaactgcttcatttaaagacgtaatgctgggtgggaaggacgggattacagatgagcctgaggaaacatttaggggtaatgggtatcttcattatcttcattgttgtaatcatttcatggatgttttcatatgtcaaaattaatcaactgctgtactttaaatatatgccatttattgtgtcagtttaccgaaatgatactttttttaaaaagttttaatgctattctaagaattttgggtaaccgtgtgaaaggctcggggagcaactgaaggaatttagagtcagtgaaacatatttaggggcatttcattctccattttacatctttacaagatcctctatttaatcaaattaaagaattaaccaactgctattttccatgcacctgtcatgtacaaaggaccaatgcgtccctaaaaaaaaatcacatctctatcgttaagtgagttatgcagatcttcattttaattcacttttaaaaccaaacttcaaagatgcaagatacagcagacgtcataaataaaaataaaaagacaagtaagaggcagtgagaaaaattgcaaatatttacaagagtagcgctatagaacatataaggagctcttacaagctacaaggcaataaaataggaaaataaacaatattaataggcaattctaagaaaaaatataaacaaccaataaatacataataactgcttcgatctcatttaataaccaagaaatatgaaataagtaaaataaaagtcaccaactaaaaaagaaaaacaatattaatgattatgcaaggaaaagaatcctcacttatattattcataaaagtgtaagtttggccaggcacggtggctcatgcctgtaatcccagcagtttgggaggccgagacgggcagatcacgaggtcaggagatcgagatcatcctggctaaaatggtgaaaccccgtctctactaaaaacacaaaaaaattagccgggcgtggtggcgggcgcctatagtcccagctactcgggaggctgaggcaggagaatggcgtgaacccgggagccggagcttgcagtgagttgagatcgcgccactgcactccagcctgggcgacagagcgagactctgtctcaaaaaaaaaaaaaaaaaaaaaaaaaaaagtgtaagttcacatgccttctggaaggacaatttgacagtaactagcaagattaaaaaggcctttcaatttagcaattcaaagactaagtatgattgtgagatgatttacatctcttcactctcaatttatttaatcctcagaacaatacaatgtaggtaggcactattactgtccctgttataggcaaaataacggtccctcaaagatatccatgtcctaatacccaaaacttttgaatgtgttgctttacatagcaaaagagactttgcagatgtcattaaggatcttgagatggggaagattatcttggattatctgggaaggcccaatataatcacagggtccttataagagggaagcaggagggtcagagaaggggttgtgatgccaaaaatagaagtcagagcaatgctgaaccatgagccaagaaatgctagcagcttctcaaagctggaaaaggcaaggaaataaatttttcccctagagccctcagaaggaatgcacccaagctaaaccattttggactattgatctccagaattgtaagatcataaacttgtgttgttttaagccaccaagtttgtggtaatttgttatagcagcaacaggaaactaatatagtcctacttcataaataagaaaatggaggtatcaaaaaatgagtaacttccaaagatcatatagctaggaagaggtacagctagaatttaaacccagacaatgtgcaatactaatgcactgccttcaaatacaaagatgtatacagaattattttttaaaaaacctgaggcacggagagaaactacaactaagtgtccttcattaagagaatgattaaaaggaaaaatcataatatgggctatgaaataaaatgcacgaatttaaaaacagtacaacatgaaaaacatattcaaaatatatgacacagccaaaaagtttcagaacaatggattttttaaaatgttcacgtgaacatgcatacattggtaaatacacagaaatggaattagaagtacaacagattgttaaaaatgatcatttgtgtggaatgaaaagaggtagtgggatacgggggacatctacattgtattcaatatttctatgttatttgaatgttttacaacaagaatatatgatgtattttaaagcgagggatttttaatgcagggagatatgcacgaatttcctacaacatttttcattaaaaaggcctcagctgcacaaagtttaaaagccctgccctacagtgacaccaaatggtggtagatcaaaatacagcacacaaacaggacatttgttcgattcaatcttcctataaatgtttgatttctttgaagaacaggaagcttaacagaattaaataacgtggagacaaatactcaaaaacctagaatttttaatcaaagaaagtctagtacaccaagcttcaactgcaaatttttaggcctctttccaaacttcagctaatcttctgatcccactgaatatttacataaatcatttctcacagttaaagcatgccactgtgaacacagtgattttacctaatagcttattgatcaaagaaagcctacaaatacaagaaatgcagtcataaaactaaagtcaggctctactccatcggaatcaacccttggtaagtaggtaatattttggaaagatggacgagaaggtgttggggataaacagggatggaaagaatccaagaagagacacaagcaatgactccaattaatgacaaagtatattttcatttgttaatctagtgatagaaaattaagctgagtaaaagaggaggctattgcctctcaaatatacaccaatttctccacaagaaaattttgtcctggactgtccagggaaaagaatatttcaaattaagcacatcagtcagtattcagtgtcctctgcccagaacctaaaccaacaaaaacagcatgtaaatggccttattcattacaagccactataaaaagatacagagatagaccacctctcagggcactcctctaaaacaccatttggccaggatccttagtcttttagcattaaatgagagtttattggatttttgatgtgttacttttcatataccaaaatctcctagaaaacacaggacatataaatatatgatcatctacaaaaaaaagtcaataatataattaagctctaaggccttgaaatcatataactggatttcaatcctaataggtacaagccaacttacgaccacatgttaccagcactactttaccccactcatggataatcagctctagaacaccttgagagctatcctgatcaaatgagtgcatgtccagtgacaagaaccacaaggagatcagttcaagaaggtaacttaagtttctgaattactatataagtgacagatgaacaactaagaactgagtaccacaaaaagtatccatgtctactacatatacatttatgacttaattagaaagagaggtaatatcagcattaaataattttgcttccaatttcaacagagacataaatatgaacatgaaagtctatattacagaaaatgtgaaaaattaggcacatcacatggtttagtggttagaagtttcaaggatatacaatttaatagaaattgacataattcccacagtaaatttgtataccatactctacaggatatagagccctagaaaactgtatctaagtgatacatgataaaagtaagacatatggccgggtgcagtggctcacacctgtaatcccagcactttgggagatcgaggtgggcagatcacaaggtcaagagatcaagaccatcctggccaacatagtgaaaccccatgtctactaaaaatacaaaaagttggctgggcttggtgttgtgcaccaagctgtagttccagctactaaggtagctgaggcaggggaatcgcttgaacccaggaggcggttgcagtgagccgagatcgtgccactgtactccagcctggtgacagagctagactctgtctcaaaaaaaaaaaaaaaaaaaaaaaaagtaagacatttccagtatacaaactatttctgatatatgctaattgaccttaattgacattggttactaatattttagatgtcttacttttacaccctgcctttctatcaaagaggaaaataacataaacatcaatatcctggtggagctacatcttatgttttttaactaattcttatggagaattaaagttgattatataatgcaagcaacttgactgaatttaatctactgtctcaagttagggtatcagtttaaataaaacacaacctttcagaaaaaattgtaattaatatgaatcaaattaatgaattcacataactggataaaagaaaacttaaacttagtggcaagtaaaaactgtagaattttaactaatttttgttcaaatgaaaatgctagaaatcataacatcagtctacggaacctaaagatgaaagagttaagagctaatttttctacagtgaaaaacaaatgaaaagtcaagctttggtcctatttggagctgggaaagcactaacactaccccaaactcttgactttttcttatatctaactgtgtgatgatttttcaggtaaagatgattagcacatttctaatgtactttaaatctaggctaaatcaagaagtaaacatgtttttaaggcaaggatgtcttgtagaaatctggagtttaattcacttcaagttaattgcccatttttgatacaaacacttcaaaaagtttattactttaaaaatgaaacattattatggaagtcttacagaaatacacttggcaattataaccaatttcttaaaatcatcaaattactgtattattgataatgttgataaactgaaaacacatcattctttagtaagttagcaaaggtttttaatctagaaaggagtacagaaaatttcagacattccagactgtctaacactctttgtccagtattttgttttttttttttttggttaattatcaaggattgtttggagctttaagcaggtttcccacttctctttggagagcaaaagttgagaagtagtagcagccagattggaaatggtgaaaaatagaaatggaaaaaggtaaaatctaagaacattactatttgacaaaaaataaaataaaaatatttcattttgttcctcaactttcattctgatttttccaccaatacaattaccttttaaaatattagtaccacagaaaccagaaccgaaaacaatttgttcaagagtatattgtcataatcaatagatgactaaggcattgttcatattgtctgtagaggatgtttttcaacaacgttattccttccaaattatattccactggcactcaggtatgacccagcatggaatgtgtacattccagattaagtttgagttgacatgtcctgaaagggaagtggtccatcaccatcttaaaatcaaaactattacctctagcattggtatctgggaatccagttgttttaactgctgatccctaaaagtacactttttgtaaatcaaagctctttgatgtgaattcttaatttttaacaaggcataacttggctattttaagtaaattgaaaatatctgcaaatttgagcagtcttcttgaatcactagaacacagaaatagttttaaatctttactataatggtaggcaacataaaaagctacttgttagatagacattttcatataaccttgcatggtatcagatttaatgtacatggaaaatatttcaaaattgtaattttatatattattttaattcaagtgtcaaaacataggtaaaaaaaaaacactctaaatagtctgtggttaaaaatgtaatgcaaattctcccttattcacctattctcttatggaagacatggcaaatagagtatcaaatagacaaactaaccaaataatagaaaagcaagcaagcagggaaataaagaaaaaagaaaggagacagaaaaggggcaggcggggaagagaataccctgaagaattggagtaaaaagtaaaaactttttttgttttcttaaagacaacgaatttaaaagttttagaaaaggccgggtggggtggctcacacctgtaatcccagaactttgggaggcggaggcaggcggatcacctgaggtcaggagttcgagaccagcctggccaacatggtgaaaccccatctctattaaaaatacaaaaaaatagctgagtgtagtgttggccacctataatcccagctactcaggaggctgaggcaggggaatcgcttgaacctgggaggcgcaggttttggtgagtcgagattgcaccacttgcactccagcctgggcgacagagcaagattctgtctcaagtatttaaaaaaaaaaaaaaaaaagttttagaataagaattataagactgtgaacaaggaaaatcatgctttttccttttgtgttctatttggagtttttttttttttaactttggtggtagcaaggagtagaatgcgtttatgaagagataggaaggaatgtaaaagcaaatgtctacaacatgccaaaatatgaggtgcaggcacagctattaagtaaatcaacctgaatttttaaaattctgtcaaacaaatttcatcctggccctggagattattaatataactgaagatgaaagggaaaaaataaacaatcttattagagaaacaacactatagtattgttataatgacaaagtgtaaccgacctaaaaataataatttaatggtaggagaaaagagcacagaaaagaaatcttgataaaaatcttaaaattttaagttgtaatacatttaatatatggcattggaaattcttttcacctctttagaccccagcttctataaaataaaaggctggagcaagatgattatcaaagattttctaaaatgaattcatttttcatcctcattgccaagaaagatactatatttataatttcggtctaaactacgagatgaattcaagtaagtgatcagaacaagaaaccaaagctactcttgcaatatgttggaatacacagctctagaataaatcacaaatatacctctctattcttaagaagtacagtttttactttacattttaacattaaatagagagcaaaaaaattatacatacaattttcaaaagccccttggacttcacttaatgccagagtttcaatatatattttaaatcaaggtaatttcacatgaatatccttaagttaaaaaaaagtaagatggatattaaatgtatgtgattactcacatgcttttttacatttagcgatataaaaacagttgacaggttctcttgtttggcacagtataaaaatcctctctgagactcggtacttaccacaaccacaaactgctcaggttcacataagttgctatattcactcttgaactgagacaatgaatttaattgctcttgatcaggaagatgctttattaagttctaaaaattaaaaccagaaagaaagatcttcactaaatgtacttcttgaattttaaaaatataatttaaaaactactgaaagaaaaccagtgaagttaatcttcagttttatttctaggtaacctccctcctaataagccttaagcaaaattccctgcatcttgaaaacagtcaattttccatttctctatcccagagttattatatattcaaatcaagcactactgaaactgaatgtttatttgattagctatataattgagaaagagaactcaacctataccaaaggaacagctttctcacctggatgaatgtgatccattacatttcagctttagggaattaaatgtcagaaatttcaggcaaagccaaacatattttaacacttcactcagggggataaaagaaatcatcatattgctacaaaaaggcatgggaagggacagaatagaaatcaagggaattttaatggcagtgcttgcaagatttaccaataggattacagttttaataataaaaactgaagatatctctaaaacaaactaacttttctgatgtgaaagaaaattttaaaaggtgttgaagacacatgatgattgatataccttgcagataaaaggcatgtagaggtcctttagaaacttaagtaagccacacacttaaacaacagaactacttgaataaagattaaaggaatacacaagactatgtcttcctgatacaacttaaatgattaaacaatcccttggacaaagtctatatcgatcctctgtatcaaaatacaatcaactataatagcgttacaagaagttagtgcattgatattaaaattaagataaaaaagagtggttggtgctcacaattccaaattacagcatgagtaaattctgtacaagcccaaagttgaatacaaactataattaagcctagatcatgctatatatatttatggggggaaattccccaaaggtgttattagttaaaaatactgttagagaatgttatacatcaaaatcaattagatcaaagaataagttattgactcactgtgtacctttggacaaaaacttggttaactggccaaaaacaaaacaaaaaaaaagtggcattttaagatcatccctagacaaagtattcactattaatactatcaaattgaataaaaataaaagtatatgatttccccacataaatagaaatttctcttagtggaattgcttgagaccaaaagacatgattatttatatttttacccattctagttgacagctggattgttagattttattacttcaggcctctgaatttctttagcatccttttagacaaatccccctgaatatctcatatataatcagattttcatctttcacctgaattttttaattttttcactccattaattttacattctaacataaaaatactattgtgatttttaagtgcgtggttccaacctccctttgtctctccccttacaaattccccacacccttcgcaaatcttaagctactgttcagctaaattctgcacagacaggcacgcatgcccagcttccctcacagcccacagtattattactgccaaaacaattgcccttcactacatttttcatgcaactcctctgctctattctacatctatacctattcaacatttacatacccttgcctccacacatacactcacaaagcatactccctcaacatattctataggtctaaaccaatcttaaaactttgcttaccttgctttacaattatgtatgtaaatgtcatttcccttgtcaaattataaattccaagaaggtcaagtctaattcttattgagcctaatatacagccgggcatggtggctcacgcctttaatccagcactttgagagaccgaggtgggcaaatcacttgaggtcaagagttcaagaccagcctggccaacatggtgaaaccccatttctactaaaaatacaaaaattagctgggagtggtggcgggtgcctgaaatcccagctactcaggaggctgaggcagaagaatagcttgaacccaggaggcagaggttgcagtaagccgagatcgcaccattgcactccagcctggttgacagtctcactctgtctcaaaaaaaaaacaaaagtaataaaacataaaaattattgagcctaatacaatgccctggacatgttgcataaaataaagtatatgaaaaatgaattaataaatgactgatgtgacaaacaaaggtaaatgggtaaaaaatgatgcagaaaagtggcatgaaaaatggcaaaacaatgacatactgctgacctgtacatatatatgaataagtaactaaatatgtcaaaatataaccatcacagtgaacacagagaaccaaaatcatgattattacaacataaagctctgtttccatgccctggtcaaaataggaattcttcgcattaaaatgaggaatatacttttaaaattaagagttcaaatagcaagaaattcttactttttaatgaatatattaaaaccttatatatgttcaaaataaatttttacattttagaaatacccaaggctggttttatatttagaaagtatgataggcacaataatgacatccattcctaaagatgtacatgactaatccccaaaacctatgaaaatattaagttacatggcaaagggaatttaggttatagatggaattaaagttgctatcagctgaccttagagtggttatcctgaattatttggatgtactcaatgtaatcaaaaagttcttataagtggaagaaaaaaacaatagagttggacggagatgtgactatgagacaaaggaattgaggaatgcaagattgctggcttggaagatgaaggaatggttctacaagccatagagtatgagcaaccatgagaagctggaaatacaaacagattcttccctagagcctacgaaaagaaacacaggtcattctgccaatactttgatgttagcatagtaagaccaatatcagacttatgttttacaggaatgtaagataataaatttgtattattttaagcaaataagttcttggtgaatgggtatagtacaaataaaaaactaatacattacaaaatatatggagctgaatgtactttggacatgaattttaaaaagcaaatcatctcttttctattatataacaaaaccacatgttcatttaaaacattcatgtaatcaagctaaaagctactctgtaaatatttaactaattcattataagaaatacaaacaagtattaagtagaaaaattttatttaaggaagttggcatctattcctagcaagaaggcacacatataatcaacatgaacgaagatgaaaatccagtaaaaaacaaactgaaagagaaaaaaaatgcttaaataagagtagctgaatcaggtagtttatgagtctcagcgactcacagcacaaatcactagtgaaattatatgaccactacatttagaagacaagataggaaaggcaaaacttagaacaacttccaaagatatcatttattgattagttaaaatattcagaataattttaattgcttgttggcactaataaatatttggtttctttttattgctaagtaatcattttcctaaatatatccgctatcagaacaaaagatggtaagctgaagataatctctcactatataatttgtgttttgattctccaactttaaattttatcaagatatacattattgatttcttatgtggaactcagcaataacttcgacatgatgctagtattcatttgaaaatactatgaataaaagccattaacaaaaatcttctagctttctgaataaattcagaatactatgtaaacaatctctaatactcataggagcccaaatgactctaagaagaattgttagtaaaggtaactgtaattgaaaactccctcaatcttctaaaccatataataatatcttcataagccaaagaaaaacacattctaaaagggctatagaaacaaattttaagtaacacattaataaagtataacaaaaacaaaaatgtaaaattaaacaatttgcttttcagaaacaataacttaaaatacttaaaatgtaatcatttgatagcattctatttcatgtgcagttaagagaagatgcagctttctctcctggcaatgcagaagttatgctaaaactaattatgcagcaatgattttccagttgaatgatttgggtgaagaattttgcttcacttacagatttctatttaatgagaagcttgcaatgaaatattgaaatttaagctgtgcctgtttgtttacctgaatcatagactctgccaaccgtgtttcatctacttccaatatcatcattctgatttcctcatatggcacccgaaaagagctcaggaagattgctaagaaggagaaagagagaaaggtttataatgaataaggtttaaaaaagtatttcagatgtagttctatttataaaatcaaaaataaattcataaaacaagagaattcaaacatttaatattatgtttgggggaaacatattatgggggaaactttcattactacattttatactcttctctagttttagaactagtgtttaaacaacagtcctgtgttattgcactggatccaaggttgatttttaaatgctcagttatttatctaccataggaatgatgtcaattttcatgtgataacaaaaaatgaaataaggtacactataaaaacatcacattgtaatgaaaataataagaaaaccacagtatgtgcatgtaatatttgtctaagcatatgtattatttgcttgtatctcttctagccttaggaaagagttcaggaaaaagtattttaagaaaactgctaagcagtacattaacacttttacaagtaatagtagcacttcactattcagaaacattgtaaacagtatgctagggaaaccttcacatgtaaccaaagcttaaaatatccagttttagaaaacaaattctcactgaaaattatccaaatgtactagatagtataatatgttattactgagaattctaaacatctttcttgatggctcttatatcaactattataatgattttttcaaaagttactgaagtagaaggatattttcacagcaacagatacaacgcttttgctagttcaacccttattgtactattatgtttttacattcaagatgtcacttcttaaccatactcagcacctgcaaatcaatagcctattatttttctttttatttaatgaatttctatgtcatctggtatgtgtatttctagataaagaaactatgttcagcacctcatatctgtgggttccatattcacaaatctgaccaactgtggatcaaattcaatccacagtaggttgaatctaaagatacagaaaccatggatataaaagcagaatataaggaacttgagcatctgtggattttggtattcatcaggggtcctggaaccaatccctctgatatcaaaggatgactattttttataaaactcaggaaacaggatctacttcttttctgtattgaggttgtattcctgatttgtgagaatatcatgtatcacctacagattaacaagggcatcatctgtattcatatcaccaacacacacagttctgaacccaagaagtcttaaatatgaaatcattacaataaaactcacagatgtctataatccttaatatcccaagaacaagatgaaatatgtaaatggtataagagtaaatagagatttggccaggcacggtggctcacgcctgtaatcccagcactttgggaggcagaggcaggcggatcacgaggtcagcagatcgagatcatcttaactaacatggggaaactccacctctactaaaaatacaaaaaattagccaggtatggtggcatgtgcctgtagtcccagctactcgggaggctgaagcagaagtattgcttgaaactaagaggcagaggttgcagtgagccaagattgcaccactgcactccagcctgggcgacagagtaagactctgtctcaaaaaaaaaaaaaaaaaaaaaaaaaaaagtaagtagaaatttataaaattacaaaagacaactccgtagtagacaatagaacatgcaaaaaatataatcactgaagatggtgaagtagggctctccagtaattctccaccctcacagaaacatgaatttgaactagccacatgtgaaagaaaataccttcaaaagagagaaaacaagtgaaaaatcacagtacctggtatagactaatactaaaaaagatacattgattatgtaaagaatgttttacatcacccgtatcaatccatccaccaacgtcaggcagcacaggaaaaaaaaaaaaaaaagagagagagagagagatactgtccacttgaaaaaaaagagaagtgaacatagaaatttccctttgtcgctaacaacaaatctaccagtataaaatgctcatggactctgattcctgacaggtatctgcagtctaagcatctagactgacactggtaccagacaggaatctaacggtcctttgagaaaagactcgagttctggcctatatcactgacggatgactgcagcgaccttcgtttacagaaaatactcagtggcaaacaggcaacagaagccatgggcttcaggaaccacccaggactgcaacaacattaagaaccacgaaagtaagcctgatgcagggccagctgtgggagccaaaaatttccagcctgggctgcaccacccaaagcacttctaggcttagggcactccctaacactgcaccaacaacagcaacccataccagatggtctactcaaaaaccctagacagacttactgttgaaagatgacctaaaataaagtcacactgagaagaatggaataaatatctacttcttcaacatgcagacagcaacacttgaccacaatgcaaaaagacaatcagggaaacatgacatcaccaaagggacaaaatcagctgccagtgatgtacactagagatggacatgtatgaactatctggcaaggaattcaaagctgtggtttaagaaagttcagtgaacttcaagaaaatacaaaaaaaaaaaaaaaaaatcagtattttttaacaaagaaaacagtttttaaaaattaaacagaaatactaaaatatacaaggtacaaaatgagaaattcagtagagagcatcaactgtacaagtgatcaagcagaagaaaaaaatctgtaaacttaaagacagtttatttaaaaatatactgtaagagaataagaaaaatgaatgaaaaggaatgaagaaaacgtgaaatttattggacagcattaaagagcaaaaacgtgtcattgaggtttgagagagtagataacattgtagaaaacttattttaaaaagtaatagcagaaaactttccaaacctgcaaaaagatataaatatccagatacgggaaggtaaaaggtgtctagtatgattgaatccaatactacaccatgacattataatcaaactgtcaaagatcaaagacaaagaggggatccagaaagcaacaagagaaaataataaaatagcatacaagagagttccagtatacctaacagcagacttctcaacagaaaccttacatgccaggagaaaatatgatgacatattcaaagtgctgaagaaaaacaacttctaagaatactttaccgtcaaaatttatttttcagaaatcaaggagagatagagtttcccagacaaacagaagctaaggaagttcacaatcaacagccctgtcttataaaaattgctaaatgaaattctgccagttgaaagaaaaggatgataatgagaaacataaaaatatctgaaagtataactcaccagtaaaagtaagtacatagtcaaattccgaatattctaataatgtaatagtggtatgtaaatcacttgtatctttaaaagggagaatagaggacaaaactattaaaattaatagtaactacaataaattgttaaggaatattcaatatggaaagatgtgagttgtgacatcaaaaattcaaaattcaaggaaagagtaaaattaatatgtagttttattttttataagtgatcaagtttatcagtttcaaataaattgttgtaactgtaaaaaatcttttagttagcctcataaccacaaagcaaaaatctatactaaatgtactacaaattaaaagcaaaaaaatcaaaacatactattagagaataatcacttatccagaaaggaaaactgtaatagaggaagaaagtaaaaaggatctacaaaacaactagaaaacaatcaacaaaacggtagttataagtccttcactatcaataattatctagcatctaaatggactgaattctcaaattaaaagacagagtggctgaatgaaaacaaaacaaaactacaactatatgctgactattgaagactaacttcacccgtaaagacacatataaaccaagtgtaaagatagaaaaagatatgccatgcacatgaaaaccgaaaaagaacaggagtagctatatttacatcagataaaatatactttaaaccaaaaactgtaaaaggagacaaaggatattacataataaagtgatcaattcagcaaaaggatgtaacacttgtaaacatatatatgtgtatatgcatgtgtgtgcgtgtatatacatatatatgtatatatatatataatttgtatccaacaccaaagcatctaaatatacaaagaaaatagatctacagggagacatacattgcaatacaatattaggagacttcaatgcctcattttcagcaataaaacagtcatctagacagaaaatcaacaaacatgaactagaaaatgaactctaggccaaaaggacctaacagatatttacagaacatttcatataacaaaatcagaataaacatccttctctcaactgcacatggaacattctccaggacagatcatatgttatgccacaaaacatgtcttaacaaatttaaggagactagaatcatatcaagtatattttctgaccacaatggaataaaactagaaatcagtacagaagaaaattcaaaaacttttcaaatgcatgaaaactaaacaacatgcttctaaataaccaatgggtcaatgaagaaattaaaagtcttcaatataaaaatgtatttagaaaattgaaaagggaaacacaacataccaaaatatatgggatatagcaaaagcagatctaagtgagaagtttacagaaataaatgtctacactaaaaaaaaaaaaatctcaaacaacctaacattgcacctggaggaattagaaaaacaagacaaactcaacccaaaattagtagaagcaagaaaatattaaagatccaagcagaaataaatgaaatggagaccagaaaataccaaaaaaaaaaaagaaagaaaaaacaaccaaaaatttcatttttggaaaaaataaaataatcaaatgtttatttagactaagaaaactcaaataaatatagtcataaatgaaaagatattacaactgacaccacaaaaataaaaaaagaattatatgagactattttgaataatttcttatacatcaataaattggataacctagaaaaaaaatggataaaatcctagaaacttataacttaccaagattgaattataaaacaatacaatacctgaataaaccaataaccagtaaggaaactgaaattagtaataagtagtttcccaccaaagaaaagctgaggatctaatacatttgctgcttaattctatcaaacatgtaagtaaaaactattaccaattcttatcacactattcaaaaaaaatcaaagagtagagaatactgccaaactcactccacaaggctggcattcccctgaaaccaaaacctgcaagaatgcaacaaaggaaagctacttgtcaataaccctgaagcaaaaattctcaacaaaatgaattcaatacatgaaaaagatcattcaccatgattaaatgggattcattccagagatgcaaggatggttcaaaacatgcaaatcagtaaatgtgacacaccctattaacagcatggaagacaaaaccatataatcatttcaatagatagaaaaataatttgacagaattcatcattcttttatgataaagaattttaacaaattaggtatagaagaaatgtgtcacaacacaataaatatatgcgttatatatgacaaacatacagctatcatcataacaaacagaaaagttgaaagcttttcctataaaatctggaagaagataaggatctccactttcaccacttctattcaacatattacttgaagtcctagccagggcaattaggtaagagaaaaaaaataggcagaaataagttaagctgtacttgcttgcagaaaacaaccttaaatataaaaaatcataaacaaatgaaacttataaaactcctaagccttctcttgatcctagtgtctggaaacctttatgaactcaaaaatataggaaaccaaaaccacttttaaatagacaagtagataaatgaatgacttttagattctttctccaaagttctaatctagtacatacccataatattctcttcaatgaactttagaaatgaacctttccattttagtatcagtattctactactgaccactgttttatttcaatttatctcattccaaaacagttctaagactcatctcagaattcagactctcaaaactctaaatttcatgacaaaaaactataattacaatgaagatcataggctgctaaagcttcttaaagcttaaatcataatgcctgctaccatcagagaggagaagaataatcttaaaatggattacatcataatatgacatggtataaattctgtatcttttcatcttacactttaaaacatgtttctcaattaaatgaataggatatatatactctagctaaattaaacaaggcaaacaggatctttctccataaaaatgttattctgttttctgtaaaaaggaacagatatacattaaactatataaacattaaaatattttcaaaatgagcaatcttattgaaatcacttaactgctacacccaccagattccctacctatactgttaatgctaatacccacctggtggggttgtagtgaagattaaagggccaaatacagaactagtaaacaaaggtaatcagtatttattagctgttttaattaaatttgaaatcccatgtagaacatgttctgtaatacataaataaataaccgtgttcaaaaagttatttaactatgagatggacatttaggctaacttaccacagctgacccattcagaaagaattctattaaacattatatttcttcgggaactattacaagactatttagaatcaacactagtaatttgtaatgcaggtcatgaacatttttcaaaataaaatcatctcttttagatcacagatacggaactttctgacattatctgacatagttcaaaacacagtgctttgaacctagacaaagttcttttgggagggaaattccctaaaatatgtacatcatgcaaaaaacaaaaaacacaaaatctctgtggtctaagcaaacacacacaaattatttctcatgaagaccatatgttcatcacaccagtttctgttaattattaattatgatccctatatcaggatgatggacaccactctgaatgccattctgggtgccagggggagcttcttcaaccaccaatgaaatgcttccaccccaaaaagtgacattaactccactcccatcttcactggtccaagcatgtcacttggtgactcctaacttgacaggggcagagatgtgcaatcagcagtgcccagaaatagagaattgaatactagacaatacaccaatgccgccatactatccatggggatcttggcaggcctgcattgtagaaaagagatgggtttagatcaaagtgattacgaaggagaggaggttctgaaattttcataaaaggaatgccaactctaccatttgaatatattgcctctaacataactctctctttaatcagtagcatggatctttatcctctcgctgaagaactgttttattccaatacttgctaaaagctcagttgaggcatgtaataattgagggagactaaaaaccatgttaattcttcatcactctagattctccccattattcatatccctcttgcaccatcagaaagtgatatatacagaccatagtatatcatctctaagcataactacctttgatgcatttagagtagttagaaatgagttaagagcaaaactatttgccttcttctctcacagtaatttggtcaagaagataatttaatactgagtatttagctcctgtaacagtaattaaatctaaaatatttctactcagaacttttgaggaaaggctttgaactgctcagatgggataactgaattcactttactcaccatccttatttccgttaatattataacctcctttatgtgtgatcaagtatcacaaatattagagattcagagttataaaagaagcaatacactaccaatttttttcaaaatatgatgtcattacctaaattccttaagtctttatttttatactttaaaaaaagggactttaaagagtagctgtttttttttttcagttatgaaaggtagaatttcattttaaaacctcttcttatttgtattttctaatatgcacttatcttttgaagcatttaatcccataatttacctaaaggagagttatctgtgaatttatcatgcatataataacaaaatgaaaatagcaaataatgaataatcggtcttaaagaaaatgaaatcatttaaagaaatatttccactgtctttgaatggtattggaatatgatacttacaaaggttctgggcaattttagaatctaaaaacttaagttctttaatttttttcttaatcgatttcttctcttcaatatcttcctcttctcttctctctgtaaaaccaagatagatccatgttaggggcagcaattcattcaaatacaaaagtggaaaaagtgaactttttatcattaaataagctaaaaaggatgtaactcttctaaataaaagttataaaaacaaataaaacgatagatatcccaagacctgaactgttgaagatagaaactgggagcttttatgccagagaaactatggaaagtaaatatttgaaggtctaacaggaaaaacaaaaataaaacttatgtatactatggaaaccaataccaatgggtataagaataactacaattagctcatttgaatagcatacaggatacagttataaaaattaaaacacctgcactcaagttgcaagtatattaattggattatgaagctagctctaagaatgctaactaaaacagtcattttatgtctaatatacaataccattcttatttaaaaacataccttatgaaaaattaacagaataaattttattgatcgtgaatgttgaatcatctatgcatccttgaaataaatcccatttgatcatactgtattatcttcgtgatgtactattggatttgttttgctactattttgttgaggatttctgcatctaaattcatcaggaatattggtctaagttttctttttatgttgggtcctcgtcttgtcttggtattagtgtaaagctggccttgtagcatgagttaggaagaattctctcctcttcatatttttggaatagtttgaaaggaattggtgttagttcttccttaaaaccttggtagaattcaacagtgaagccatccagtcttgttggaagactgatcaacttccttactcattattggtctgctcaggtttcctattctttctgatttaatcttggtagctacgtgtccagaaatttcttcatttcttctaggttttccaatgtgttggcaaacatttgttcataattagactctaacaatcctttttatttctgtggtatcagttgtaatatctccttttttgattttgattttattcatttgggttttctctttttcttctaatggtttatcaatttaatttaaaaataaaacaacttttcatttgtttaatctcatattgtttgttttttgtttgttttgagacagggtctcactctgtcacccaggctggagtgcagcagcataatcacagctcactgcaaccttgacttctcaggctcaattgatcctcccacctcagcctcccgtgtaactgggactacagatgtgtgccaccacattcagctaatttctttttatttttcatagagacagagccccactatattgcccaggctcgtcttgaactcctgccctcaagtgatcctcccacctcagcctcccaaagtgctaagattacaggtgtgagccacctcacccagcaatgtgtcttctttttttatctgtttcatttagttctgctctgaactttattatttctttccttctactaactttgggtttggtttgttgttttcctagttccttgaaatacatcactaagttcttgatttgaaatctattttttatgtaggcattttttgctacaaacttccctcctagtactgtttgtgctatattctaaaggttttggtatattttgtttctactttaactcatttcagaaatattttttattttcttaatttcttcataacatattggacattgagactaattgtctaactggacattagagaagcaagctgtataatttccatattatttgtaaagttcccaaagttcctgttgttgatttctagtgttactccattgtgagctacaaagatacttaatataattttgattttttacaagttgttgagacttgttttctggcctaacatatggtctattctggagagtgttccatgagctgaagagaagatgtgtgttgtgcacctactggatgctatgttctgtaaatgtctattagattcatttggtctacagtgcagtttcagattgatagttctttgacaattttctccctagatggtctgacaaatgctgaaagttaaattctccaactacaactatattggagtgtctctctccttgtagatataataatatctgctttaaaaatctgggtgttctggcgctgggcattcacacatttaaaactgttatattctcatgctgaattggtccctttatcattatataatgatcttgtctctttttatctctttttgacaaagtctgttttgactgatacaagtatagcttatccctgcacactttgacttttcatttacatacattacattttttcaatccctttgctttcagtcactgtttatctttacaggtgaagtgagttattgtagacagcatatatttgcatcccatttttttaatccattcagccagtacataactttcaattagagaatttacactacttataatcaaggtcattaatgggttagcacttacttctgtcattttgttgatcattttctaattgttttgtatatcctttgtttctctcttcctctctgtttatctttgtagtttggtggttttctgtaataacaatatttgcatcctttctcatttgtgtgtctgctctatagggagctttttacttttatgtgttttaacagtggtagatacagctttcttttgcttccagatatatgactcccttaagcagggagtctagcagtgatgaattccctcagtgtttgattggctgggaaagactatttctccctcacctgtgaagaacagctatactgagtaaagcattcttacctgacagttattttctttaagcattttgtaggtatcatccaattctctcctagtctgtaaattttctgctaaaaaaaattgatgttggtctgatgggcattctcttatatgtgacttgacacttttctcttgctatttttataaatcactctttgcctttgccttttgaaaatatgaatataatatgtctcacagaagagtttttgagttgaatctatttgggaatctttgagcttcgtgtatctggatgtctatttctttcccaagacttagagagttttcagctattatttcattaaataggttgtctatgccttttcccatctcttctccttccagtaatcccaaaacacaaatatatatttgcttaattttatcccacatgtcacgcagactttttaaatctttttctctatttttctttttttggtttgtctgggttatttcaagaaacctatcttcaaactcagaaattatttcttgtccttgtctagtctactgatgaaggtcttgattatattttttatttcctttattgaattatttgattcaagaatttctatttggctctttttttatatctatctctttgttgaatttctcattctaatcaattgttttcctgatttctttatattgtctacttgtgttctctgcgcttcactgagtttccttacaatcattattttgaattccctttcaggtcttttataaatttctttttatttggggtgtgttatgggagaattactatgttcctttgaggtatcatgtttcctttctttttcagatttttttgtgtgtccctaaagtgatatctgtgcacctcctctaataatcacttctaattttatagagtagctttaataagctaagactttttcctgcagatgtatttacagcatcgattaagtagagtgtttggagttttgggtgggagcagccacatagtctctgtgtgatttcttcagctataatcatcagcagtgtctgagatttcctcagtggcttaggctgcagttgtttgtggaggctttggtatgactttcatagtgatgaagatgaagagccaaacccaaggtgggtctgtccttgagcccaagtggcatgtatatggataccagcaggccctagtcacatcagtccttcatccccggggcagcaaacataggttctgggaagactagtccttgggcccctgggggttgtacttggggaatggcagtaacagtcaggtggcacatgtgatcgtatggcagtcccacactggaggtggcgaggtcgctattggacaaaattgggaacttgataagaaagaagagtgtagcaatgtgttttggtagatatgtaaatcactaaaggtaaagttcaaaatctgaaatgctccaaaatctgaaactttgagtatcaagatgacactcaaaggttatgttcaaaggaaatgttcattggagcatttcagattagagagatttggattagaggtgctcaacccgtaagtattatgcaaacattccaaaatctaaaatacaaaacacttctggtccaaagcatttcagataagggatattcaacctgtatattacaattatatattttggtacatagcatgaggtaagaatcaaattttccatttttcaaaacatttgatatttctgtgtcattttatataattaaccatctttctcaactgattttaagttacactttgatcatataattagtgtctagataagttatttctatttttctgggctactagttctgctacattattctctgtgctactgttaacactgctatcaccctgtcttaagtactatagatttatgatacgttttattcattggctgttcaaattatttttctccatatctaaattttgttcttttttttttttttttttttttttttgagatagagtcttgctctgtcgcccaggccagagtgcagcggtgtgatctcggctcactgcaacctccgcctcccaggttcaagcaattctcctgcctcggcctcctgagtagctgggatttacaggctcatgccattatgcccagctaatttttgtattttttttttttagtagagacagggtttcaccatgttgaccaggttagtctcaaactcctgacctcaagtgatccaccggcctcagcctcccaaagtgttgggattacaggtgtgagccaccatgcccggccctcatttatttctccacatgaactttagagcaatccaaaaggtctaaaaataaaatccatttgaactgtatttgaattgcaaggtaattgcaaatagattctgagagatttaatatcttgacaatttctgaacttccttatcataaacatggcatgtgtttataattattcaacttagcacagtgttcttcatacatgacctgtatattttatgttaagtgttaggtatccaaaggacatttgtactcctaggtattgtgtagaaactttgcctaattttgtatacatgttttataatcaggattttacttattttgtctttcattcagataaaaaaaattattaagcaactaaaaagagactgtgttaggcaacaaagatacaatgctagacaagatagagaaattccttgcctcaaagaatttaaggtctaatagaagtgactataaaataaatgacaattataatacatggatgtattagtgatgttatagtgaaaactacacaagaataaagaagagcaccctaactatgcttgtcaaaaataatccttttgggataaatacctaagcaaagcttgaaaggaaaaatgagtcagccaggtaagaaggtgggggtatgtgggaaagacacaacaatagaagaatagtatttgaaggtgtaaaggtgcaaaaactctaaaggcactgaaagacttgaagataataagaacagaaaatattaaacagaaataaatgacaccagaaatgagtcaggtaccagatcacataagatattttaagccaggctaagacatttggattttattctcacactaatgaggagccactgaagatttaagcacatgagacatcaggataactatattttaggaaaaactcaggctaaagaaggtggattagaagaatggcaaaaattacaatagaagggcaagactgaaggaagttacagtaatccaaacgaaagtcaatggtaccttcaccaagggcaataacaacagggaaggagagtgtggatgagttccaaaagttgattctgtagtgggaaatagactaattattgatccagcccaaatttgtctcttgaactccagacttgaataaccaactgctccctctcaacatctttatttggatgtctaatgagcacctgtacttaacatgcccaaaagcaaactcctgacatatacgtgcctacctccatatctgctctcccaactattttcttcagcttaaaaaatgggaatgttctttttgctattttcaagtcaaacgcttgaattttgctactattcccctcacgataatatcctatccatcagtgaatctagtcgattctaactccaaaatattcactaaagtaatcactcctcaccattgccctggctacaatttctctttttgtggccaacatattttttcacctggaccacagccggtttctaactagtctccttgctttcaggcttgactagctgtagtctctccactacagtgcagcaaatgaatcctgttaaaaacttagtggcaaagccttcccttactgccttatatagaaagcaaactcttcacctggtgttctctatcaccattgttctgacttttttctccttcaaagcacttactccttacatatcataaatttgatattgtccctcttcctccattagaagataagatccttagaggcagaaactttgattgtcactatattcttagcaccaggattaaagcctggaacacatcaggtgctcaacaaatatcttttggatggacatacatgtggtcacttgtgtgtatgtatgtatgaattggcagagtaaaagagaataaagaggatactcaggcttaagcaatcagatagatgataatgatgatgtttatttagataaacgatggtgatgtttatttaattcagcaacagttgaggaacaggtttggactagtccagtttaaaacatgttcagttacagaagctcttgtatatccacattagtcatgtacaagaggcagctggacatacagatgtggagaagagaaaatgggaatgatgatacaggtatcaatcctagtaactactccactaactgtcacaggttttccagataccatataacaacactttcatctccttattcccagaatttaaaacttgtttctggtcttgttgtattagttaaaattttcagatgaaggctaataaaaaagttagtaggattcccttccttaacctgaccaaatagcaatcctcaacttctcagaaaatgtatacattttattttcttgtctttattcttaagagcagactgtaactttttaaaatgtttacttttctcatcattatcagtatccttttacattctgaaacatttcgtagtctacctaaagaaaaacgtcaaagacacaagtaaccgtaaattttaaatcacatttactgaacccctattaagtactgcactgaaggctttctgtttccgtttcttatataattctcattatagtcatcctaatactactactagtatcattgtcatcatcatcatcacaataaggaaaaataacgcttagggtaattttaagcaataaatctgataaaagaatgatgaccacctgacttggactccaatattcttttcactatctatgaagtatgttaggtgtcacagtttaaaaaaaaacaaatacaagcaaccttcaccacttcaacctccaaataagacactgatataatttaaccaattctaccttttgaaaataaaaatgacaaattagactcacttaatttaatgtatcagcatactcaggatggtgagtatatacccagtaaggtaatcctcttctaccatcttcactgctatcatatagtcataggattgttgggacaaaggatcaatggaacttagatagtgagaatatggacaaagggatacaaagaagcagaactgcctaagagagaaaacaacagaaattttaaaaccaaaagagaaatacttttttgttgatatgaagccagataatgagtctattatacaaaaagattgatttggaaaaatctttcatattgagagataacaaaagttttgtttgttttttattttttaatgcaatcagggctgcatcagtggaaaaccagcaaaaatgttttatgcaaagaccactgataaagccgcacataaatgttggcaacaataaggatgaattaaaaacaaatgagaataaaggaggacatttagtgagaatgaagtttttgtacaaaatactatttctgctagccatgctggcaatacctctggtaaaatactagcatgcctggaggaagggcagggtcctctgtctgggaactcaggcctggaatcctgacaacaggttctacatcccagcctgccacatgctagtagctaaacctcattatggctgtgattgctcacctatgatatagggatactggccctctatgagtagttgtgaaaatgaaatgagatgataaataccttcatgtaaccctccccctgtggtgacaaagaagagtacgatcagagtccataaacacaatttagcattcaagagtaaagcacacttcaggctcaaacccatgaatcggtggagctactcttctaaagccagtacaaaatacacttactctgaaagactagattttctcaaatataacatgaaactctgaatcataaagtcagattattagtgccatctatacttgtgatctagctttgttgccattagagttttgtgtttaatcttacttcctagagatgctgtgtaaggctccatttttccaagagaagattaataccgttcaaaaactgttctgatcactaacacagcatatgcagcattttataagggttttatgtcagaatgaagtcaaagatgacaaaagttcctatgttgccaagagccatgaactgaaaaagtctcttttaattacattttctcttcattctttttctattttcaaagtttcaaaaatagtagcaaaattatgtaaagaatatcatttcaaaatcctttctttcatactaaattttccatttaaaaatcataattccatgtcacatggttatacatattattccagttcattttccattatgtactaatcagattgattaaaaatatagctttttaggagtaagatttcatataaatgttatcatacattatttcaccattgcaaaagaaaaaacacctcagaatatgcagtcttaaatgttttagtagtcagtataggcataaaaggtaataaaaaccagttttctctttctataactgagtattttaaatcagtaaatgttactaataagtgtttactctgcttttgttggtgctccctggttaaatgtatcttatgacaataggcacttaaaatattaagccttttaagtttttttctggtatgcctttagcatagatattattaaattttacatgttaatgtttataataaattacctttctaaatagactgtaattacactagccttaagagtatgaaaataagtatatctgaataaataagcaagcattcttctctatgacacagagagaagataataaattcaactcaactaaaaaaataaagtaagcaaaataatttacctagaaaatgaaaaacaccagtccctgacagtcttcaaatggggagatatctatgaattacttgcataatggctgttatttttctttgccttctaactcatgagattctaagaggctgataaagagtatcaaaatttgaaagatacaaatttttgaaccagaacggcccttcagtatggactttaaccacctcattctataaatcaggaaacctaagcagagaatataagctacatgctgaaggtggcacaaggcttggctatgagcagacctgagaccaggaactgaccaccacacagcaagcctagagcatcctctgggacatggaatttgcatgaggaaagcagtctgcaaccaagcacattagaaaggataactccccacactttgcatttacacttgatccaaattttcccttgctgtacatgttcaccaggacagttagtggaaactgaataggcctgagggagggaagagaaatgtttagtctccagaacacaataaacaggatttaaagctttgggaaataactacacagttgactcttgaacaacacgtgcttgcactgcacaggtacacttatatgcaggtatttttcaataaatgtagtcagttttccatattgacagactcccatttgcaaccaaacacagactgaaactacagtattctcaagaagcaaagcctgtggatatgcaaggtcaactgcaggctgggcagaaccaactttaggacttgagtatgtgtggattttagtatctgttgggttcctggaaataatcccctgcaaatacagaaggatgactctggttccaaaggaaaagtcaagaatgcgcctatcactacctctcaagtagtgggtaactttgctttggatagggttcagttattcagcaatatagtagaatggaatacacttgataaacttaaaggtcagaaatggagaataggcaaacgactgagaaaaaaactaaatttctgagagttaacaatataggtggttgataggacaatatggtttcaaagaaggtttaggtagctcaaaagcaaatgatacagaatacataggaaaaaaagtcaaaaaatttggaatgtttttatgagatggcaatagaccgttgggaaaatatcgaagtaaatgctttggtattgaaaatcacattgtataaatcactttagtcatatctggcttcccaaaccaagttttaatatttctaggcacataaataaatgggtgtgtacctaactacatagaaaataatcagtggagaaacagataggctatttttctattcaaatactaatatatgactgccataactaatcaggatattttactagcaaaaagaagtctgtttgacaattcaaggctaagaattatataatatataggaagagtagctgaagccctaaataaaattttgtgaaacagattatttcaactgtagcaatcataaaaaatgtagcagataaatgcgtatttctctttctgtgacattctgttttagcagacaatgtcacaaaacaaacagtcttgaaggtcttttttctgcaagtcaagtcctacatggacaggaataagaatctcactacttaataaacccttcattatgggtatatctagattttttttagccatagtcatatgtacaaaagaactgttaaagtatcgggaaataccttgttaaaaaacttaaagtacatacctcaaaacaataaagatttttacaaaggctacctaaagaatgcttcccctacctctttaatcctatatgaaattaaaaatcaaaatatttcataaaaactgcttaatatccaaggaccttctaaattataataattagcaactttgctcatctcaaaagtacgacccctacaaaaagaaccattttattgaggtctccttgggtataatcaccccctcataaccaaagatttaactagcagaaaaacaagagttcaaatcaaataaaatattaacaccattcaaaataacagatgaaacaactttttaaattcacaagctgtggattagggagaaaaataatcctgaaaagttaagcctatctatcacatatatcttagtgttaactgggttcattacaatttgagatgagctctgactgaatagatctaaggactgagagaagaaagtaaaagatatcaggaaagagagttcaaaacccgactgaaggaaaactgaatcctgttctaacatcatctatcttggctcatcacaacttctccagaaaacatccataaatttttatgtgccctcaaaatctcaccaccataagaaatacttctagtatctggcccctgtgaattcttcttgaatgttggtgtttcccagtcatggaatcatacatgtatattcataaaaattaatttgtccagctgggcacggtggctcacgcctataatcccagcactttgggaggctgaggtgggcggatcatgaggtcaggagatcgagaccatcctggctaacatggtgaaaccccatctctactaaaaatacaaaaaattagctgggcgtggtggcgggttcctgttgtcgcagctactcgggaggctgaggcaggagaatggcttgaaaccgggaggcagagcttgcagtgagctgagattgcaccactgcactccagcctgggcaacagagcaagactccatctcaaaaaaaaaaaaacataataataataatttttccactatttttacgtataacattctctcatatgttctctgatggtagaaatatatctctgctagaataaattacaaaaccaactctgaaagttaatgtatgacatacgaagacatatacaaaagaaagtacaagagaggagaaaagtcatgagtgagaactcagtgtacattcctaatttagaagaactaaatccaaatgataacacaggtaattcaggatctctagcatggtgtcgaatggaaagagttgataaaccagcttactagtatttgtacacacaatgctaagcaacttgagactagaagaagtaacaatacattatattaacaaacagataaaaagcaatgccacattaaatcataggcagaccatcctggcatattcctggggaaaacagaacacaatcatcaaaacagccagagtgattatccaaaacttgatagaagagaagtgatctgacacaaaaatgaccattattccaaaatactgaaaaagaattgactgacagcaaaatggtcaagcttaagtagtagaattttacaataaacttacttctatatttgatgacagcatgcctataattttgtgatcttgttttgggaggtggggaggcaggggaggggacgggaagcaaaaaaagaaagaaaatgctttattgtgtggggaatggagtgtgggtgtgccagggtagaaaagaggaggagaaggtagagacaatacctaggtatttgttcaactgaactcaacttttattatctggactttctgatacgtagttatcctgtctctctctctctgcttttacgttcttgtttttgatagctcagttgggaattcaagtcacttgcccagtttctcagttattaaatctttatttctctgtgctctaagaataatgccccagttagcattccagatcattctggtctccaattggtctagctaattggagttccattatttgcctgatctgtgttctagaataaactattctgtgctagtttctgtccccacaatctcctgaatttggaatttttattaatctgggctgttaaaatttgtagttctatgttatcttaccttctggctggagcttgtgttgtgtacatcctatatagctatttataacacccggcttgcagtggcacaggcctgtaatctcagcactttgggaggccaaggctggagtattgcttgaggccaggatttcaagaccagcctgggcaacaaaatgagtactcatctccacaaaaaacgtaaaaattagctgggcatagtggtatgtacctgtagtgctagctactcaggaggatgaagtgggaggatcacttgtgcccaggagtttgaggctgcagtgagctaagatcatgccactgcattctagcctgggcaacagaggcagaccttgtttggaaaaaaaaaaaaaattaataaaatgcccagctcacatacagacctcttttccactgtaccatctaactgcaacccaaatgttccatatacacttccctagtagtataaggaggtgaggttaaaggaagactagcaggattcattttatattgtgattagaaaatgatatttttaaaaataatcttcctgagagagtagagaatggggagttagtgtttaatgggtacagagtatcagctggagaagataagttctaaagacggatggtactgatggatgcacaacgttagtgttgctaatgccacagaactgtacagttaaacatggttaaaacggtaaaattttgttatgtattcttaaccacaacatttaaaaatagaaaaaaatttctttatgaggcttgatttcaaatcactcattttaatttgacctcttgatttgaaaatttatgtaggaatcatgtagttaaaattttgctttgtcaaatgaagaacaaaaatctaagtggctgtaaaattaatcagaccaaactgggatcatttaaaatgtatacgttctttcccaagaggtgttcaaaggcagagttggtccttattcactgcacacctcaaacttatacattggtttgactatttatataatgatatagataatgctgttacaaaataacgatttctcttctacctctcacccagattacctctccaaattgtacaaagaatttcattcttgggcaattcagtgtttcaagaacctaatcgcatttctatttccttgaatacccagctctcagatttctaagcttatagtagcccatatcaattactccgtcattaaaggtgcatagtgataaagccagggcagacttttacatgaaaggaagatcttcatcttttcctacacagaaactgactctcttcagcttcttgttctttgtcgcataaagacaggtggcacatggataatgtatagaattagattctggaaaggaaacccaagccatccttatgcttaaaagcctcaaaccatttacccaggaccagagaccagggagatgtatttggaatattcagacaaaagccaagttaacaatgaaatggctctttatctaggtttgttgtggatccctgtatatacatattgacttatattgactaaggcaaagtcaccttttattttctagttaaacaatacatatgtatatgtatctacagggagaatgaggcgtgtgtgtgtgtgtgtgtgtgtgtgtgtgtgtgtgtatcactaaggaatcccacaggaaaaatggagagctaagccaagtcaggattcagaaatccctggatggtttataatccttcaagccccaacaaaaactccaaagaatataaaataagcaatactttcatccccttgccaatgtccatatttaaagttaggctacttataaaatgaaaatctcccaatgttttcgagcctgcccccactcccctaaacaatcttaccttcagtgtaacaaccaaatctgctattaaaaagaacgtacttaacagagctgtattgtgaaatggggagcgaggtaacctttcgttaatgggaatgcagtggcttaaattgtattagaaatctcactttaaactcaattactttacaattatgtttggccacctgacacttgggcagagaagaattaacatcttagtgaagaagaatctttacaagaactgaaatatcccttactgtaaactccccaacctaactaattaaaaactatctttaaatgcttcatgaaaatgtcagaaagtaaaagtttttgttcaaaagacatacaccaacaagccaacgcagaacagaacaatactaaacagaatacctctgacatccaggaacacctattaattgggactctggctcatgtcaaaatttctaatctctaaaatgtttgaataaatcatattcatatgcttaagactattttacttcatgttggaaacatcaaatctgtatttcatataatttcttgaatttctgtaagactcaaatcctttttttcccaattaaaatggacagtgggatattatctaatggacagtggaatatcatctaattaaaaaaaatctccaataagaaaccattatttccaataagaaaactaacccataagaggctaagggcctggcaaatgaaaatgaggactctggactctcattcttgtgctgatgccatcctggccattcaaagcctatctagcccatcagtagaaactgcaaatgtgatgacagaagaactaaatgaaattaaaagcagaatgactaagattcattctaccctgcagagaaagtagagccagataataattggagatgataactggagattaatatttttctttcctgaaatttgtccaatagccttgccatttcaggatcaatggcatttatttcctctggggagaaaagataaaccctagaataagaggtcattcctgagcactgagtataaaattagatttctgttaatatctacagtgagacaatagtcttgaaagctatgtggttcaattgcaaaagctggttacttacaggaaaaaaaattaatgcagtcacaaaacattcctttaactatataaaactgagaatagggccctactataaggagtggctaggaaggatgcagcacatgagaaaaggacagagtgtcagacatagggaagacacaaaagcccttcctgggccaagagagaactcgcaggggatcagaaggacaagatcagaattcatatacacctctggagggtgtgctctcttcctcctccctcatggtgcaaggctgaaggagagccacctggggagtaactccaaagaataactaaataactaaagagatattagagacccccagagcagagggtatttgtggccagcttcctgtctggacctccacaggaagaccgcctcacagaagcctctaccaatatggggcaagcgctagagacaaaaatagtgcatagtatgtttagacaagtgtgcttgtgacaatatcttgctttgtaagtggttaatgggagatgtaaaagcactaaaagagtcagcggacatattttcaaaaaatatttactacgttgcactagatttttcaagtaacaactgaaaaattctcattggatataaaatcccctgcaactcaattaggaaaaaaaatgtatactagcagcaaatatcatatttcatatttcaaagaataaggcagcaaagaaggatggcaaaaaaaatctatttcttcccaatatgtacatgcaaaggcccaaaggcattataacatataaaacacgtatttctattgacctatgtaataccttatctcaaattatcaaatttaacatcttatccccatacttagctcttttggcttagtttcccaaatactcataatgatttctcagcttttcacaagctgctccttctaagcctgaagaagatatatatgatttttcacttcatcaattacttccatcctcaaatttgagcaaatattcttcaggataaccattatacagatttccttcattacaaatgagtgtcccttttgatcacaggcaccatttggaataattaactatcaaatatattgctttctgaatggagtttattgaattaatgtaaccctgtgtatgtaatatacttgacaaaaatttctttcactttgaaaagctaaggtcatttctaagctgtaactttaaaaataaaacaaatgactcacagatcttgcaacaatttttttagattcatttatattgactaaggcaaagttgcctttttattttctagttaatacacatcaaaatatataaggatttcaaaaaaatctaaacatgctattccagctaattgccatattattctagatttgtcccccaggaaaagatattgactttttaaagttcattgtgaaacaattcaaacaatatagaagtacaatttttaaaaagtaaagtttccccacacattaatacaaatattccccaaaggaaactattgaaatgatagttattgttaacaaaagctactgctggtagccttctgaaaggctacacatataagtgtataagggtgtacataaacaaaaaagatgtatacacatgtatacaaatatacaattgaagggtttttttccttaattaaatgagctcataccatatacattattttgcattttacttgtttcacaaagcaataaacccagtgtaattttccatgttcatatgtctagatcaacaacatttgttttaacagcttcatagcatatcacctggtaccataatttggctacatataataatttagctattttccttattaatgagcatttaagttgtttataaatctttgctatcaatattactaaaatattcttgcatatttttccatatatatataagcatttgttgcatctacttttaactgtgccgatgtaataatctcgttctcttatgagaaaagacatatgatcaatttaacaccgttagcacatttcctcttctatcgagtctgaacaaaatgggctttctggtttttaaaaaaagtttattttggcagtttatttcttaatgtcaacgaagatcagcagtttcaaagaattgtagaatgttaagctaccaagaactcttattttatagatatgtaactaaggcctggagaattgatttctccaaggcacacagctacctagtggtagattcaagacaagaaatcggcttcctgcttctagaccactgttactgtaccacactccatttcctggggaaggacgaacacagacacacaggaccaagaaagccctgttagaacaataatagcaactggaaatgtaatagctctcaatatggagctcctctgagggcttccctgtcatgataaagaaaatcttaatctatttcgttcattcattcactcactcactccctcccaaatcactgagttaggctctctatagaagaatacagaaaagtcaaatgttaaggcttgctcataaagaatctcggttgaaattggaacaataagatgtgaagatgtgaagatctattggaacaataagatgtgaagatataaaattatacaataacataatcatttatataaagtgaaaagcattacagagttcaagcaaattctgatatttattctatcagaagcccagtaaaagtttattaaaaggatagtaaatttttcaatgaccaaaggctttgattggcctcaattatttgaggtctcactaatacttattaataataacaattactactatttccttgaggccaaccaagggaaaagatgatggaggctgggcacggtagctcatgcctgcaaacccagcactttgagaggtcaaggtggaaggatcacttgaggccaggagttcaagaccagcctgggcaacatggcaagaccatgtctctacaagaaaaattttaaaattagctgggcatactaactcatacttgtagtcccagctacttgagaggctgaggcaggaggatcccttgagcccaggaattcaaggttgcagtgtgtgataatcatgtcactgcactccagcctgggtgactgagcatgacactgtctcaaaaaaaaaaatgatggaggacttagaaagttaaaagaggcaataacatctcagtagatggaccaggaaaatcttcacaaagtaaatggtattacatgtaggccatgaatgattaacaggggacaaaactggaatgcattcctttcctctcttctctatgaagagctattttccaaatataaatatatgcatttgtatacatacagagaaagaagcaaactatggctctgaataagttttccatacagtgtagaagaaaatttgactaaaatatagatgaatccaaaagctttaggcatttgcagttttattttctggaagacaactggagaataggaacacttgtttcaaaaattatcacacataaccaatcttcacaaggaagcagaatcgtaaggactcaaatttggaaagaaaaattgatagatttgacttctactgctacccataccttgtgtacaatgggatttttgatagtttgtttaaatatatacatttattattaatgcatagttgaattaaaaactactatgtttaacactaacttgtttctagcaacttttctgtgtgttagaaaaaaagggggggggctattatcctttatacctccttttagaaccttttagaaaggagagaggcaaaacatgtggaaagaacttgcccttagtaatcaatctttccaggctcataactggccactaactaacttgtaacaccaccactccctcttgcgggccagcaacaccatcatcaacatctacataactatgccctaagctaggggtatttcaatattgtaccaatgcttcctttgcccctaccactcctactgctggattggccctcaccttcctccctgctttcaaaaatcatatactcatgcttcaaaacaactcaaatgtttctttgaagattttccaaaaaatccacacctcaaatctcatctcctgcccttgtctccagtcacactaaacttctgatggatcctagatcacagattctttccaatctgaggaccttccatgactatcctctctaaacacacccctcatcataccttgctcatttactttcatagcacattcaaaaactacagtcatttttgttggcctatttattttctgtcttctccattagattatatactataggaaagcaagaagttatctgctcagcactgtatcccaggagctaggacagtacctttcatgggagaggcatccaatgttatttgctgcttggctgaataactgttcagctggctgcatgatttgccatgatggacccagtaaccaaaacgagagccctgcttactgatagcagatagctgcaatcctaggcatagtactaagtagcagctagccttgagggaatatgacttgtatatccaatttcacttgctgacagaaaaaaaaaaaaagccacactagcactaagacttaagcacttaatacaataggaatcacagagctctgagaagaaatagtccttaagcacaaagctgctgggctaggaaatagggaggccctcttccacagaggaatattgacatgagaaccagggtcaagaggtacaggtgagtatttctgtcctgtttccttcatgactcaaggttaatttacaagtattttccataacaattataattttaccaaaaaaagattaaaaatctatgaattaaaatttaaatgaaagcttcacatattaaaaatatgcttacgaagaaaaaatgaagacgaacactctggcttattactgaaagcttatacattaagtaggcagtgagttacagagagctgtctccatagtggacataaaaaataagaaaatatttctcaatgatcaacaaataacccaaatatgtcaaatgatatctctactggcaacacttttatggcttccatacttagcgctcagatttttttcatctattaaatgagaaaatgatagctatgatctagtaactttacaatcctatgatgattgaacaatcttccacttttttgtacttctgttacatgttgcaaagcattgtgttcctattatattgtcctttcagctaaaatggttaagtaaaaacaaatatttgcacaacattttacagtttacaaagcacagaatccagtttggatacaatgcaccaagttcaagattattaatgatggggaaagtgatgagagaaaaaaacctcccgaacactacctgataccattctttacattgttcatttcttccaaaaaaagagaagtatttgaagtttatgctcaatagatagcatatgaaacacaatgttcacaacaataaattttaaaagttcctaaagagtatatagacagctaatttgaagtagcacacaaataaacaaatgctaaaaaagcacttgagtcatttaaaatacatgcaaacacacaaagagaaacaaacatgttgctgatgagtactggcccatgcttacctacttagacagctattgtgtacaatattttaattcaatcatacttaaaattgcaaagttattcttctaaaaatgtaagtacataacggatatgttattttttttaactataccaccactgccaggcacaactttaaaataaaatgtaatacaaaaatgagaacatttgaaaatctggtacgataagggaaaaaaactcttaagataaaatggatgctgaagtgttgagttgcacccaggggtcaacaacattgtgtctattattcagctgaaacacagaatttgcctttagataccattttaatgttaaatcaagaactgtcaatcagcaccatttgtttgtaatccctcatcagaacccattgcctcagtctgaacattcataggaaagaatgcagagggcatatctgcaaccacttaaccttcatcaaccaacattcatgcatgctcattaacatttttttcatcccactttcgagcatgacacagctcataccggaataataactcgctgataattgttctagacaacagctggacaggcagagtgcagaggtgaacattctcatagattatggggtactgtaatgcattacaattagtaaaagagtcacatgttcgtgttgaatagctttcaacagaagtgaaggaaatgtcattatcacaaacagcaatctcctctaactttaactctgcatggtccaccgcctgattctcttaacgctttcctattttgaaataaaccaatgaaaaacattgaccctgttactgtactatttcatgaaaagaagtaatatttttgatgtgttacaatcagacacgatctaaatttgtgatttaatttaaagacagaaaagcaggaggagggagaggaggaggaagagaagagtttcacatcttactaataacaattgttttgagcatgatggtgtacacctgtagacccagctactcaggaggctgaggtgggaggatcatcacttgagccccggatgcggaggatgcagtgaactgagatcatgccactgcactccagcctgggcaacagagcaagactctgtatttaaaaaaaaaaaacaaacaaaccacaatcgttttgcatgaagtcccataaaatcattatttattatttttgctttaaactgtcaattcagaaaaataaattaatatcactgaagaaatctggaatatcaataaaaaaggagtcctacatagggaagggaatttagaatccagtccaacatcctattcataacagctttgatagctacttctttgccataatgcaataaaaataaaatggaattaatatgataatgataatactagttgccatttttagagtaatgtgagtcaggtatcataccaggcactcaacagacacagtctcttaataatcctaaaagtagtattaactctctttttcagatgagaaaattaaagctaatctgaaagagactgaaaattcatcccaagtcaaaacattatggagacaggattccaaccaggtagtctgattccaaagccgatgcttttcacctggcttcatggttaatttccacattagaatcttgtttattttccattatttcatcccaattccttggctgtacaattctttgactctgtagaattagacctatttctagaaggtctttattccaagacatagcatttatacttccacattttctactctccttgtgtccaagaaacctgctcttaacactcagataatctctagtccctgtacgtctacctagtttccattacacttagtttttgttgttgttgtttttagagatggggtctcacttggtcaccaaggctgaagtgcagtggtgtgatcatagcttactgcagcttcaaaactcctggcctcaagtgatcttcctgccttggcctcccatgtagctagagctacaggcatgggtttatcaggcccagtgtgttttttcgtatatatgttgggtgtttgtttttgtttttgctatattgcccaagctggtcttaaactcctggtctcaagcaatcctcccaccttggcctcccaaagcactggggttgtaggtgtgagctacctcaccagcccatgctttagattttctaatcaaacttcttaatgtggttctttctacaccctttctctgccttgcttgacataaaaagaaagaaggaaggaaggaaggaaggaaggaaggaaggaaggaaggaaggaaggaaggaaggaaggaaggaaacttcaacaaatttcatttaaagatctaatttaaagatcttatacatgattcattaatcaggtagcatctcatctaaaaatgtagaaaagtgccacaataaactgagcagagatggttgattttatagctagagaaggggtaaagaaagcaggaagaaggaacaaaaaacagactggtcatttttgagttactttctttatagggttaaaacaggggacttccttatcatataggctcaggtaaaataggccccttctgattggctgctgcgaatctcctatttttcagaaaactggcacatgttaaagttcaatttgattaaatggcacctagcacaagtgactccattctggtttgatctggcatgttaaggccaagtgcaacagcttagtaaaagacaatggcctcccatgaattttgtttagcaacatttagtcacaaatatctgggagaggggaatcaagaaacctaatagatataacagtctatatctctagtcctacttgtgattggtgctccttgttgaaggaaatcacatcacctgcaatgggatctactataatttaataatataatctgaaataaaacctcagtaatataaccagggtcagcaaactatagccccatgggccaagaccagtttgctacctgttttaataaatgaagtataagaggaacacatatatgaccattagtttatatagagtctgtggctgctttcacactgcaatagcacagctgagtagctgtgacagagaccatatgacctacaaaaacaaaaatatttactattcagtcttgtatagaaaaatgtggccaacttataatctgtagtggagatccataacagtatcttgagtcaagcagataacaataaaacctatttatctttagcctaaaatctacagacaccagcttgattcactctataatcctaaatcatcccatgctctgctttcttcccaaaatctaccagctaatgattgtctaaacctcgtggatcacacttcctcaaagagcttttatagctaatgtactcccatggaagtaacctagattcataaattcatcaccaatgcccttggtaataaaagtagtctcttaattgacattccagtttctggactttacctactgcaacacagagctgtgtgatactaaggtgtcatgctaaaacatagattataatatgttatgtctccatttaaaactttgtgacaatataatattttaatttatttataaacgtgacagaagaaaatataaatgcctagattttgcatataaacctccctaatgtaaacacaactctttctaggttcatcttccagtgacattgtcccatatatatcttctcattctcaaacacagagcagtatatttcactgctgatctttagctcccaagcctacgtgtttccccaaacaccccagcagcacatgtttcagtgcctttgttcacactcttgacttcctctccttatttgtacgttcactcatccatccaacaagcttattaagcaatgataaacatcagacactgccctgagtaaaaggagtagagtaggcagaagacatagttcctaaccactcacacaactaagaattttagtagaattacaaaccagagctatgaatgaaaaataaagggcactgtggggttgaatcacaaaacctatgccaatctgagaagtcatagaaatcatttcccaaaggagatgacacataagccaagaaatgaagtatatgaggtgggcaaagtgaagctatctccttcatgatacttttctaattatcccaattaaaatcaacaggtttttaaatatacttaatagctgtgatataatgactaaatgtaatactatacgatcagtcaagatatgaaggctatttaatagcatgagaaatatgtggaaataactatatatatatattgttatttactctagcagtataaacactgctagaaaacaaaagttttgaaaagcttaaaggaaatttaaattctacgatgaaattgaatagtgtagtggagtttagggtggtatttttttctttcatcaattttctaaattttctgtaacataattattctataatgaataaattatggcagcttaggtaaacaagctttatataatcttaatgaaatacataagtaatgttttatgtgtacttaactattaagacactgatgaggtttggttgcatccccaaccaaatctcctattgtagttcccataatcctcatatgttgtggttgggacccagtgggaggtaactgaatcatgggggcagttaccctcatgctgttcttgtgatagtgagtgaattctcacaaggtctgatggttttataaaaggcattttccccacttcgctcagcacttcttcctgacatcatgtgaaggacgtgtttgcttccccttctgctatgattgtaagtttcctgagacctcccaggccatgctgaactgtgagtcaattaaaccactttcctttgtaaattaccctgtctcaggtatgtctttattagcagcgtgagaatgaactaatacagacatacataatactgtatactgtattacctataacacatatatctttcatgtaaaattgcaagcttctcagtcatatttatgaatcttctgccatcattcactcaataaacttcataattaaatactattttgatcttcatatttccctacttaaagactttattagtttctataataggcattaatatacttgattttctgttatgtcccatcaaacttttataaaagcatcactttcagtaaaattttgaggtttttaaagcttaaaatcaacacctataaaaaattaaaaataacaagtgtgggcaaggatgtggagaaattacaactcttatacattgctaataggaatgtaaaatgattcagctactgtggaaacagcttagcagttcctcaaatagctaaacatagaattaccaaataatacagcaattccaatccaaagtatttatccaaaagaattgaaaacaggtattcaaatacatgtacaccaatgttcacagcaacactatccacaatagccaaaaggcagaatcaccctaaatatccaccagtgaatgaatggataaatcatggtataaaactacaatggaatattattcaaccattaaaagaaacatagcactgacacatgctacaatgcatactcaaaaatattatgtaaagtgaaagccagatacggtaagtcacatattgtgtgattccactgatatgaaacatccagaacacataaatttataggcagaaaacagattggtgattgccaggggctaggggaagtgaataatggggagagactgcttaaggggtccagggttttactttggaatgatgaaaatgttttagaactagatagaggccgtactaaaagccacaattattcatagttaattttatgtgatattaagttttatcacaatttaacaaaaatcaacaccaaacaaaggagcaattttcaggaaaaatacctacaaaatgtgttagagtatgtttgctattaattgctcctggtttgtagacaccaatcagggtgcatccaacaacaacacagaatttacctataatttttactttcctccttcttactttttgctgctaaaacagaaggaaaaaaaaggtgaatcattttagcatctaggtcctgaacctattccactcccaaccaccttcattattctctgaatttttttaacctaatttacaagagtctgctattcactcagagctaaagtcatcagaggcagagttaattggaatctagatcatttaaatatttctactccccttccaaaatttccatttgcttaaaatgaaaaaagacagtttgcttgaggaggctgaaattattgcatttctgctttaaagaaatgaaaaagcattcatttatccagcaaacattcaatgcccatatgtgccaagcattcttctaggtgcttgtgatacatcagtaaatgaaacaaagagctctttagtaaaggagcttaaattccagtgggagtagggagagaataagacaacataccgaatatataagtagctaacagtatgttagaaggagataaatgacatgaaaactacaacacagtagagaaaatggggatggcgtgaggacaaaggaaaacatggcaggattaatttgggagttgagcatgggaacctcattgagaaagcgacatttgagttaagacttgaaggtggtaaggggctcatggagcacatatctggagcatgaatgttcctggcagggaaaagcccatggcaggagtatacctggcatatctggggtacatcatgaaggttgcccagtatggtagaagtgaaagaattgaaagagaggtaataggaaatgaagttggcaagccaaggagtgggagaataaaatgtttccagaagcttcagcattttccagatactgagaaaaaagggctcaactgtttgaaggtagaaagagaactacatggaatgtggaggacaggggcagaatccaggtgggctctccaatgcctggtgaaagacgtactctaagtcagtcagccacagctcccagaaggaaccaataggaattttggtaggagataaagaatgggtaaggattacaaattaaaacactcaaggataaatgatgaggacaaaaggaaggggcaatgaaatgcaaagccaaatttagagaaaaaggagaccaatgttactggagtaaacgatgtgtagagcagaaaagtaacaaggagaaaatagctagatacacaagttagacctgattgcagaaggctacaaatgccagactgagaagtcccttttctttttaatcttttcgtatgtgtgcatacaaagtatatgataaatgggatattcctcaggaccataaatctgaagatagtttgcattattgtctttaaaaaagaatatgaatagaaagagcaatttggaagctatttttttaaagaggtatttgaagaaagtatgtaataaatgaaaggctatcgctgtttctaagtgtcaagaaacaaaataaggcaaaataggagatgtaactgtgctgtataagtagtcagggttcctgacaccaaggtccattccataccaatgcataaggtccttcaagatgcacctagtatgctctcatgcctttccctccctcctgttctctaatgtctgtgaacaggatagagaggaaagaacaaaagttatgaagtcaaaaagtaaattcttgattttcaactcctttctaataatgcaaccttgacagacagagttttaacttttgagtctcaccctcttacattaaaataaggcaaaagcctaaattacaaatgtgaggactgggcaccatccctggggttattatgcaaggcactcatttttcctttaacttgtaagttacttcctttatctcattcccttttgcttctaacagctgctctggccttataaccccaatataatcaaaaataatgataaaatttgggttattatggttgtaggacatgcttattcatcaagaacacattcacaaaacaaccgtcttaataacggatacctcagagatacaaaagtggacaggggatgaccatgtcaggtggttagttgacttctctggattcaactctcttattaaataatataggtgtgtattagtccattctcacactgctataaagaactacctgagactgggtaatttataaaggaaaggggtttaattgactcatagttccataggctgtagagagggcatgactggggaggcctgaggaaatttatagtcacagcagaaggacaaaggggaagccagtacatcctatatgactgaagcaggaggaaaagggagtgaaggggaagtagctacacacttttaaacaaccagatctcatgagaactcaatcatgaggcagcactaaggggatggtgctgaaccattagaaaccacccacatgatccaatcacctcccactaggtcccatctccaacaccagaaattacaattcaacatgagatttgggtggggacatggagacaaaccatatcaaggtaataacaaatgaaataatccaacgattactcaactttagattttctggtttatggaatattctttcatatatatatatacatgtatatatatatatacatgtatatatacacacacacttttatatatatttgtatttgtatttgtacatatgtatttttatatatgaaaaattctattataaaactattactactgatatgctttggctgtgtccccaccaaaatctcatcttgaattctagctcccataatcccatcatgggagggacccagtgggaggtaatcgaatcatgggggcgggtttctcctgtgctgttgtcatgatagtgaataagtttcatgagagctgatatttttataaagggcagttcccctgcacacggtctcctgtctgccaccatgtaagacgtgcctttactcctccttcacattcctacatgattgtgaggccttcccagccatgtggaactgtaagttaattaaacttctttttctttatgaattacccagtctcgggtatatctttattagcagcatgagaagcgactaatacagtaaattggcactgcagagtgggcgctgctgtaaagatacccaaaaatgtggaagcgactttggaactggataacaggcagaggttggaacagtttggagggctcagaagaagacagaaaaatgtgggaaagtttggaccttcctagagacttggagggctcagaagacaggaagatgtgggaaagttcggaacttcctagagacttgttgaatggttttaaccaaaatgctgacagtaatattgacaataaactccaggctgaggtggtctcacatggaaatgaggaacttgttgagaactagaataaaggtgactcctgctatgttttatcaaagagactggcagcattttgcccttgccctagagttctgtggaactttgaaaatgagagagatgatttagagtatctggtggaagaaatttccaagcagcaaagcattcaagatgtgacttgggtgctgttaaaagcattcagttttattcattcagaagatatggtttcaaattggaacttatgtttaaaagggaagtagagcatagaagttcaaaaaatttgcagcctgatgatacaatagaaaagaaaactcattttctgaggagaaattcaaatcagctgcagaaatttgcataagtaatgaggagccaaatgttaatcaccaagccaatggggaaaatgtctccaaggcatgtcagaggtcttcatagcagccactcccatcataggcccggagacctagaagggaaaaatgatttcgtaggcgggccagggccttgctgctttatgcagtctcgggacttggtgccctgtgtcccagctgtagctaaaggggcaaaggtacagctcaggctgttgcatcagagggtgcaagccccaagccttggcggcttacacatggtgtcaggactgtgggtgcaaataagtcaagaactgaggtttgggaacctccacctagatttcagaggatgtatggaaatgccaggatgcccaggcagaggcatgctgcaggggcaaagccctcatggagagcctctgctagggcagtgtggaagggaaatgtggagtgggagcccccacacaaagtccccactagggcactgctgggtggagctgtgagaaggcagccactgtcctccagtccccagaatggtagatccactgacagcttgcaccatgcaccaggaaaacccacagacactcgacaccaccccatgaaagcagccaggagtagagatgtaccctgcaagaccacagaggcagagctgcccaagaccatgggaacacacctcttgcattagtgtgacctagatgtgagacatggagtcaaaggagataattttggagctttaagatttgactgcccagctggatttcagatttgcacggggcctgtagaccctttgatttggccaatttctcccatttggaatgggtgtatttacccgatgcatgtacccccattgtatctaggaagtaactaacttgcttttgattttacaggctcataggtggaaggaacttgccttgtctcagatgagattttggactgtgaacttttgagttaatgctgaaatgagttaagactttgggagactgttgggaagacatgattggttttgaaatgtgaggacgtgatatttgggagggaccaggggtggaatgatatggtttggctgtatctccacccaaatcttatcttgaattgtaactctcataatccccacgtgttgtgggagggacccagtgagaggtaatttaatcatgggggtgggtttttcccatgctgttctcataatagtgaataagtctcacaagatctgatggttttataaagatcagttccccttcacatgctctcttgcctgccaccatgtaagatgggcttttgctcctcctttgcctgtgccatgattgtgggtcctccccagccatgtggaactctgaggccattaaacctctttttctttataaatacccagtctcaggtatgtctttattagcagcatgagaacagacaattatagttaccatgcagaagctgacacaaactgccgtttttcttgctattagtactgaaaaactgccgaatctgcaaaagtatttaatgaaaacacaaacaactggtcaattttaaaatgtatttatgtatatacagatacagaagatacaaaatgaagtaaaataaaacttgggaaagtaaaatattcagaaaaagcctaactttaaaatagaaaaacataaaatctctaaagactaatacccctcatttaaaaacaaacacaattatcccattggctattttagctctcctgggttgaatcttatgctagggaaacagaaagccaaactgtcccactgtgacctgtgaaaccctgaaaaataattggttctctaatcaaaaagaaaagaagattaaaggagaaagaagagccctgcttcaggaagaatgagtctaaggtaatatgatgatagaagagtggactggaaaatgactaagccaacaattaaattaaaataaattgcttattttgtgtgaaatgtcgctgcaatagatcttttgataaatgtgatttccctcagtgataaaatttttccaattaaaataaactttatatactgtatttttaattatccatttaaatatgcaattataataacatatattttccatgttgtgataaaattatatatattcatatccattattaggtctgcgtaacatttgaactaggaaaaggtctctattgccagagtctctatcacatgaacagaaatattcaagtaaaaatatgttgtgaaacatcataaaacaagagtaacaatctgtgttttaaaataaaaactttaagataaggaaacttagtttatcaacaggcaatgtagacattgttatcttttaaaagttaataatgtataaatcttttctctagattagaactagtttctctttcaatcttaaatagtagtgagagtcacaaaaaatgtttttaaatgccaatggctctttaggtttatagaaagtatttccaggtttaaaaacatatatgaaataaaaacatatataatttaattatttcccagaaaaaaatgaagttagtagtatatattgtaaactgcaaaatatataatacactatgatacttgatgcacattaattaaatataatattttgaaaaggaaggggaaaaaatctttcctggtacttaagaaaacacaatataagaatttttcctaaaaatctagaaaggcatttttggctgtggtgacaaaaacatatgttaatgtgacttgatatagatctaaacttcaataaactttttttttttttttttttttttttgagatagagtctcgctcctgttgcccaggctggagagcaatggcacgatctcggctcactgcaacctccgcctcccgggttcaagcgattatcctgcctcagcctcccaaatacttgggattacaggcatccgccatcataccctgctaatttttgtatttttggtagagatggggttttaccatgttgaccaggctggtttcaaattcctgacctcaggtgctccacccacctcagcctcacaaagtgcggagattacaggtgtgagccactgcacccagtcttcaataaaccttttgtgaatagaataaatgatttaagaagttgagtcaaaatgccccaggactcctaaaatggccttcctataaaaggaatgcaagctaaaagaaagtgacataacacaaatatgttcatttaactgtgaaataagaaattttatggcatagagttgttccacagcctctgctgccaaagatatcaatgccctaatttctggacccagtggatattttaccccacatggaaaaaaggaactttgcacatgtgatcaaggttaaggattctgagatggggaagagcagaatggattacccaggtgggcccaatttaagcccgtgtgagtctttaaaagaaccttttgtaacttaggtcagagttagagaaggagatggaatcatggaagccaggcgagagagatctaacaaaatgacttgctcggctattgctggctttgatgatacaggaaggaggccacaagctgaggaatgtgggtggcctctagcgactggaaaaggcaaggaaacacattcttctccagagcatcaagaacatggtcctgttgattttagattagtgagacccatactggacttatatagaattagaagatgataaatttgcatttctaaagctgctaaatctgtagtaatgtgttatagcagcaatagaaaactaatacaaaggccatttgtgagcataatgattcttcctgtctctagctaagctaagctgaaattgaagggaaaactaggaaaaatagatgagaagctaacctagagttctcacatcactgggatattgaattaaccaattctaggaccaccaaccaccagacttcttgttttaatcattccctgcaggcaaatttcctcaatgattcacaagacaagactgatttatatacactaatacagaatgtaaaattctaaggtttttttccaatcacagatttggggggctataagtcatattctgagttgaataattttcacttcaagagttctgtcctcctcatctattacctgtgaagctagtagggaagtataaatattcactttcatttaagctaaaaactaaagacatttctttatgtgtttccttaataatttgtcaccagtttaggaaacaagtatttagttgaaccgtgtgaaggctgcgattgtcaaaatggtataatggcatatagttcactcaactaatttctattagcttgcaccacacaaatggaggagaaaaaaaggagtaatccattcctaaaaaattatcactcttccaaaccttctgctagcaatctatgaaactaaaaacattaagagttatcacgcctcctgcaaacccttgggagaatttagccatacgctttatctggcactcttatttgcctatcaaataaaggctctctatgccttaattcaacccagttccataattatattgagccatctctaccatcctcactaatctctgaaaatgtaaataactgtcaaaaataatgaattattagcaaaaacaagtaatattttatgagactgaatgagcttttcaagatcacccccaaagtcaccagttctatgctctaaaactgaatcacaacaagaaaagcagtttagaatctcagctttcaaatctcaaaattacaaatattattaggccccagtcccataaatgagtcatcaactgaaaggaaaaaagtcatggaaaaaaaaaatcagcaaataaaaacgagctttatatttattcctgattcaacaaatccctgtctcgagaaacttaatgaagcacttgacatttaagacatacataaaaatgaaactagatatacagaataatctattattattttctaaagttaatggtatgaactagtgttacagtagtctccataagtggctattaacataggtcagttaacacagtagtttcatgatttagaaagtttcacttgaaagcaaggctacagtgaacataggccatttaacttgttacattgtggaagattcagagatgatacacaaaactttacaagttgaaatgagttctgtattctcaacatttaagttcagctaacatttcctgagcaactacaatgagctgggcactgcaaaagatgctttacaatatgcattatataatcctcacaataacctcatgatatgggtattatgtcccccattttatagaggaaagaaactacgctgtaaaagccagggtcacacacttgtagggtggactccacaacatccctcacttcgcgtgtatattacacagcatggtgttagtatttacagctcaaatacttacagaagtgaatagaggtacgaaatgatgaaagatggttttaataaaaaatggcaagtttttaaagcctttaatatacattgtggaatgagggtgaactgctgtggggcagtggtaaggtggcagaagatgagaggaaaattattttaaatcaatgcagagcactttaaataaaacataataggatttcttttaatcagagaagcagcatggcatagcacaaagagcaatggctttagactcggatctgtattccattcagaggggctgcttcttttagctgaaattcaccgaagaatgtaactttcttatatataaatgtatacaatatctgccttgattctttcacataaatgtttctgggagcaaataaagtaacataagcaaacatttgactagtaaaaaatacatcaataatatgttgttttattattatctaattaatgagtttcatattttgtccagatttgacctaagtatacttttattaataaatgcatcagagtagtctgctaaagtgagattcaaaaatggacagtctgatgttgaaactgccttaaaacattattctaagttggatgaaatatttcattacatgtattggttctttgaattaaaaaaaagaaaaaaaggcaatataaatttaaataggcagcagttaagctgaggctcaggcccaggtctttgatgttacttcactctcaccactgcacaaattagagagtctaaattaattcttaaccttttttgccaaagaccccattgacagtcaaagaagtggaccctttctcaaaatagtatttttaaatgcataaacaaaaatacataggatttcaaaggaagtaaattatacttgaatgcagctatcaaaatgcattaaacagcagtttatgaaatagtaatacacatgtgaggaagcaatgtagatgtgctgctcagatctccatttaggaagaactttccattcagccgcaaggagtgcatttagctgacaggcttcaagttgttagcacctttagaatcctccttagcttttgagtccaggccacactcctcctgggcagcccccagccaatggctgagcctggcacaagtagtaaggactgccattaggacccaacgagggactcccctcacaggcatcatttgttccagagctccttcctggctagactggctgagaatttatcaggtttacaccatggtctaaggtttttcccgcccggtcttgcatcctgacccttaaaaaaaaacacatttacactccagcatctctgtgtctgcttccaggtggaagcaatcaacaaaatctgcttctttattaatgaattaaataacaagatctagttgcaagtctaataactaccttaattttgaaatactgatcattttaaatgatatttcaacttaactaaaataattctaatgtattttgaaagtatatgtgaattgtactcatggaaacttaataggtactgctatgtttgttacctataattgaagaaaaagctaaatttcaattagaggttaaagtatgtgggttttttttcctattcaagttcagaccccagaattctatttgcagaccccaagttaagaatcctgggataaagtgtctgattttgaaacatccattcttttaagatacagagatgcacttagacaagtgaaagctgtggttaacaaaaggtctctaacctggcttacctactcagatgccaacgcacatgtgaaagcttctattaaatgcacagaatacattataagatcatatgcccaaatgatttaaccttgagggacaagaacagcttatctaaacacatgaatgcataatcacctaaaaatctaaactgtgaaattcaagattctaaaatatataataaagttatttttatacagatttttctaagaatatactatactgtttaacatcaaaatgctacatagaatttactacttactatattataccatttatttgctatactatttatttaataccaaattgctatatagcatttaatctagcaagaagtcctctgtatctacttctgactctcctatcttgaccctattctcttcctgtgttccaaggatggtatcaggttaccattctaactctaggtgattccatctcttctagccaggcaaacagtgtatgtaatgggggggaggggaagggggagaacaggtaaatgaatagctagatttacaaatttttcttcttaaatagagacagggtctcactctatcacccaatctctacttttgtagagacaggtctcaatacattgcccaggctggtcatgaactcctggcctcaagcaatcctcctgtcttggcctcccaaagcactgagattagaggcatgagccattgtgcccagcctcaaaatattattaatgccctaagattacaatagtgcattcagaaggataagcctcatttaaatttccaggtgaataataacaagcactaatttgagccagagtcttgaatgacagaacatgatgcagacaaggcaaagaactgcctaaaatagggaagtgaactttaagcaatcggagggcaactggaattgccctggtgaaatggagagtaaggcagaagacagagaaaatggaagataaattctgagacaaaaggtgtgagataacaacaatgaaatgtaacaactttataattttgttaagggatgatagctacggacacaccactaagaacttactaccaagattaaaatatcaaggtcaacttgtaatatggaaaagcaacagtatcctccaatctaccattcgtcaagtgactccagtcaaatccattaccctagtatctttcctttctccagtagaagtaggaaaggagaaaaaagaaggaaaaagctatgtgtatgtacatacacacaccaatacacatacaccctagtttcctctctttctgtttgtaacatctgtacagtatgcaagaaacatgtctatttatagggattcaaaacagacatgttttttgtatactgtacagatgttacaatgcataaatttctaccacactataccaaagatatgctgtaactaagcatttaaccaaagcattaggtggacttgcaagtcttccttggctccaagctaaataaatccactttctttagcctctgtctttagttcccatttcgctaaagctttcaaaataaatttccatttcttccgcaccccaacagagaatatactataactggtaacaataagatcctttaatgggaagataagatattcttgacccatttcataatttctttaagtctttactacttttgagattcagccacagacaagaaccaaatgatatgtccctagagaaatatttcattctctactgactttctccccaatctttccaaatcagtatttgtgaaatattctgttcttttcaggaaactttactatctataaaacatgttgcatttattttggcatcatctctttattagcatgcattacaaaaaaacatatttctatgtgttcaccttaatgtagccttgtgaggtagtttaaaaaattttatacacatttgtttgtatagaggaataaattatgtttcaaacacaatgcaacatcttgaacaccgccaagttgctgggataatccacgtttatcacctacttcctcaattctttgtccactgaactatgatgtcagaaatctaagcttgatttgtttttaagtggataatccattaactgtttccatatgccataactattcagttgagaaataatttataaaccaatttatgggccctatctggcaaaaatgacacacctgttataaaatatgattacttcagaaagctaacaattgtggaaccacattttcataataaattagtctaagtgaattagactattcatatactttcagaaagccctttaatccctattaacagtttgtgaataatgaaagtagttaatattaattttacttgacaaatccaacaccaataacctgttagtatactctaatccattttccaacagcctgtaaaaattaaccaacagatgcttccaatctggtaaaaaaaaaaaaaaaaatacataggtcattagcattattttgatgataccaaatgttcaatatatgaatattatgattaaatttcagagagatagataaacaatctttttttataaccttgttaagtcttaacagaagctgaatttagtaaaatgtcagtcttttctaaaatcaaaatcagcatttgttattccactccttgttattatgcttcaactaagtacttgactgagtttcatcaggaatgtaaaagcaacatgagtatgggaagcacacctgccttattcatgctggtatccccaatgtcaagcatgaggcacaacatgcaatatgcacccaataaatagttattgagtggaacagtggtagccaataagaaaaagtggaaggtatgaaagaggaggtatgagaaaaagaaaaaacataatctggaaaagtgcttatatacatttccagaataatttaaaatacagaaagctaagatgtctcccaaaaacttacaacagagagaatcaagaaaactgaagtgagctacttaacagcaaaataaagtgtaaaagaaaatgatgtaagtgaatcaggaaaaaattactgatttttcacaggaaaaggattagagaggattcctattcctctacagatatggcacaaggtactttcccacagaagcgttgttgtaaatggtcacaaagattagtttaaaaagcagaataggtaagatctaattggaaaaaaaaaagtaggaatgtaataaaaggcaacaggaattaagaggaaagagccaagcccttaccaagaatatcttggtaatatgtaaatgtaggtagggttggatagtatcacaagaagccagaattgttttgccatcaggagaccaggagaaaagatctcagctgagatacactaaagattaaacaagataatatgaagagaacccagctgaggcactgatatatcacgtatgcacaatatctgatatagatattagctccttttccaactctaagtgtattagacctgtaaatcccagtagtctaaacattagaagtcctgaaaacctaaagtagtgtctaccataagaaaaaagccccacttacttgacaacaaataaagtctacatgacagaaaacttcaaggatctctttaaatgattggattcagttcctttgttcttactacccaatttgaatgcttgggaagcacaaaggattggcatctatcatttaaatgcctgggatggaatgtccatctttgtaatcaaagaaatagcctcggttctcagtccaaacagttactactgcaatgaaaaacagagatacaccatttctctaaaaaacccactattcttcagtaattaccatccttccctacctagttgtgatgaaaatcagccagcagccaatgcctctacctcctgcactggcttgcgaaagggtggaaagacaaatggattttcaccttggagtgaacaatacataagtgaccaggtttacttttgtttgggggtttgcctgtttttgtttttttgtttttttgtgtttttttgagacatagtcttactctgttgcccagactggagtgcagtggcgtgatcctggctcgctgcaacctctgcctcccaggttcaagcgattctcatgcctcagcctccggagtagctgggactacaggtgtgcaccaccatgcctggctatttttttttttaattttttttagtagaaatgagggtctcatcatgttggccaggctggtctcaaactcctggcctcaagtgatcaacccacctcgacctcccaaaatgctgagattacaggcgggagccattgcacccggccatagttttgaattctgcagcaattacaaaattgattcaaacaaagtatgttggactcagggagatacgtgaatgtaacatttggacccaatgcctcagcagccaggccatgaataaaagaccacaagtagacctgtctacttgaccagtcctgtctaagctctctggacatctttctctttccttcctttctgatctttcctattaaatgtctatataaaatcctgtttctctgaacgtagcaatgactggcctttcctataaaatactctgaagtgttttacatgtaaatacacattttaattgtcatatattctccttgattgccagatgaccagtaatgccaaaaagcactcttaggactcctcaaataatgctttctaggaattattctttaaaatgaagtcccaaaaaaatagtcacctttacagctcatctctgcttaccactgagaaatgttagcagggctcggagtcacaaccctgggcttccccactctttgtgttccccctggaaatgtcatctactgtcacagaaaaaaaagaaagcagcatttgagttgaattgagacagaaggtatcatagtcctctgccagcctctaagtcaagtaaagagattccaggccaaaggaccagcagtacaaaggcagagagagatggaaatatggagtatgcaaaaaatgatcaccttttcaccttaatctttctaactagtattagatagagcaaatacatcatttttttattcaaccttgaatctcaaggctaaagttagatgacttaagaattttttaaaggtccaattatttcatttagggctaacattgcagctaaattaaagacatgctaacaagtttcccttttgagcctcattaattaagaaagtaatcagagtaaggagaaaaagagagtagctgtatggcagaattacttaaatagtttttaggtaccaccatttgtacctactaggaaagcaaaaggaaaactaatcaactccagattatgaaatctgaaattctgaagtgttttacatgtaaacacaaattttaactgccatgtattttccttgattgccagaagagtacactaatcttatttgaagaaaattttgatcctccataatcaaaaggtaaaattaaaatcttattcacaaatttactagggtgagcttgctgagaaaattctccctgtgttcaaagaccaaaaatataccatttttaatactttagtcaggataaatggtactcaaaaatatctgttaactgtttttatcaaattctagaaaactaccttaatttacaattaccttttggagagagtttctaatttacattaataatttcttaatttacaattaccttttagaaagagattctaatctttcagaaactcattcaaaggaatactaatacatttttaaaatatctgccagcattctttggctgctgtgctcaagttaaacagatacataaagcatctagcatggtgcctggctaacagtcaacatttaggaagtcaactcaaccctctacacaaaggtctctgacctgtatccatccagtacaatctctccctgccacctcttcctttgttctatgagcccagggatataggtggcataagtctatagtgaaaaatttctttttgaaaattaaaaggtaatgattgatctaagtgttttgcactacagacctaaaatgtaagttttatataatacttaaaaattctgtgtggatatcagccttgaaatgtaagtagcaggcccacgaaattggatgaaataagttcaattttcacttatgtaatacctaaacaattttttaaaaatcacactgcacaggtaaaacctatcacaaaacattttggaaaatgaatgccattgcttttaatgaaaagatcatataacctactcagatacttctctttcaagctaactttgaagacattataaatctgatatttttatcccatgtgactcatagcaattaattaaattatgtgatagtcactgtaattttttttggattatactttaagttctgggatacatgtgcagaacatgcaggtttgttacataggtatacacatgccatggtggtttgctgcacccatcaacccgtcatctacgttgggtatttctcctaatgctatatgctatccctctcctagctcccctagtcactgtaatattaaagggtagtaaaattctaactacaagaaagcacacattttgtttttctatttttcaaactgaaggaccttctcatgccaaaactgtcacagaaaatatcctcttttacaaaagtctaatttatcccaatggaatatcttcaaaaataatatcatatagaaaatttaataatcaaaattttatattaaccttttgcatttttaaaacagaatttactttttaagcactttatttcattataccatttatttgcccattaggaatgtaaaaataacatgtacaggattcataaaataatgttttctgaaaattgatacataaaaagtatatgttaaaattctaaaatcaaattaataaataatcaagatgttaaacttacctttttgttggcaacaaaatgtattctcaagtttacaaagcaaatccacgttttcatacttattttcatttacttttatccagaaacagttttcagtcatttcatgaggtctgatctacaatcagagagaagactgattcatcaataggtgagtgtttcacctgtcccaagtcaagcactatgcatacactgagtatcatagctgtcagcagatatttataaagtcgtatctgtaagatttttccctgaagtgtgttcaataagatacaagttctgcaggatgttaaggtcttattaggaagaaaaggcttccatgatccaatagttgaggatttgaaatacgatttaattagcttcttctcaattgcatttctcatagtctctaataatcttcacctgcactatacattttggtgggcaggacacattatacagcattttccatgtttctgttaccatgaaaccatttttctgcaggattctgaattcttaagatctgactagatattagcttctgacaactagttaacactttcccaacatctatcaatagagaaaatttcctaagaacaccatcatttttttttgagaaacacttcataaacataggattcactgcaataatgtttaattatcaatttaattacaaatcggattccactggaacaacatcaactctcactgtatttataaagcagaaagtcttagtcaatatgaaagggatttgtcccaatactttaaaaaaaaagctattttattgtcactttgattagtgacattagaaattatgtatatataaattaaattatgtaggcataaattaaatctcattagaaattatgtatatataaatccaaaattagatttagatctaagtaaaagtattttcctctattaatttcttttacctttaaccaattcaatcttctcatgctgatttcaggtttaaattctttctttggtttcaacccaaatggcaggattggtagaggaggagaattttgtcctccaaggaatcccaggggaggtggtggaggcacaggaccactgaatggcatccgcattcctggaagtggaggaggtggtgggggaggaggtggaggcggcacccctccaccagaaggcagtggaggcggaggaggaagtgctgagtggccagttccaccttctttagagggaggcaaaggaatattacaatcagctggcaaggcaccaaactggagaaaaaaacaataagagacataactaagaacatatctacaaaacatgtaaatatgcactttactcaaaaataaggcattcatttaaaccaaaaataattacatatcagtaatttcataaggtttaaccaaaaatcaaaattccaacaatttttcttctaatttaagaatataattatagctttttttccctcataaaaacataattgccagaagtataattccctgttttgaggtagttatgaccatctaggtagaaatgtccaggagggaaatgggtatgtggatctagaagatttgaaaatcagtagtctctggagaacagttgaagccagggaagcagagaagttcactcatagtatggagagaatatgtagcatgacaaagggtctatgcacagagttctatggagtgcaagcatttaagtgataagtaagaaataagatttcaacaaaagaacttaaatggtattgccacatcatgactttgctcaaatcttctcaatggtgtcctaatgcacttgagaaaacaacaacaacaacaaactaaaattcttcgtaggacctatataagtatatcatgatctagtccctgctatctggtcttgtaggggactttcttctaattctgtgtatgtgccaacctcatgctaatttcagggcccttgtacatgctggtccctctgcctggaacattctcttcacctgaccatctcctactagcctcttcagtctgagctaacaggtcccttccttgggaaagccttatctgaccactcattttacactgatagcaccttgtacttttcaatagctcttatcaaaagtgagaatttatttaaggaatcattagcatttatctctttgacagatcataagctgatgaggtaagtgactatcttgtattatttactgctctttccccagcacctaaagcagtgactggtgcatgacagctatggaagaaatgcgtaggataaatgcatgaaagacaagaagagaaaaagccaactgggcacagggtcaaaaactatgaatgaagagagcaccacctaaaagactgctttgcagaatcaaatgccacagagaagcaaggtaaaatcaggggtgaaaaaagaaccgcctgtgtccactggtcacttttgtcctcatgtttccatggcataataagaatttaacagatgcatttcgatggatacaaagaagacattctgggttaataaataacttttgtaatatgagtagcttcttgaaattacaaacttcaattctaactacctttaacatttaataaatgttacataattttgaattttcatggcacaattatgaaaaatagaccatgtataaaagctcgaaatcaatgacgtctgaaatcatgacaaagaaaacagtgttataaaagaagttgaggccacaaatcaaaagcatgccttatcaaaaccattaagtataaagaagaaccagttcagtgttactctgggttgctgtgatcaaagatgatacttccttttgaacgtatttaataattaactatcaatgtcttaaagatatggctgaatttctgctctagaatagttcatttgataaagtgtgaagactgacttaaagatatggtttgggaggccagacactgtgactatcttgctcatcactatgtctctccagcacctaaactacctggttgtgaagagactacgggagcaaaggaattaaatcacagataacagaacatattttattcatactcttcatagtcagcatagctttgaacaaaaagaaggatcttaagataaatgcccacatttcataagaaataaaccagaatccaaagaaagaatttgccagttgttcaaacatgaatatggtggccaatattaagtatctaattctaggttttcttctcatagccataaacatgggtcatcactgtatacaatttaaaacaatttaggagattccttgatttaatttcactttcaaaacatacacttattcccattttatgtaaaagcactatgcagcaataacttattcaaaaatggtggatacgttttttataaactggaattttctggagatttacaaacaaaccttcaactgaacataattaaaaagaaaagaaagttcttaaatttacgttaccccagaccaagaaaaacttgttataaatatttcagccactgtctgtaactcagtctgaagtacagacacaatcaaatgtttctttcaatatgagagacaaggaaccatatgggaaagataaaaaaaaaaattcaataaaatgtgatacttccctcttgcagcactaaagaaagaagatgaatgagaataattttcttgtagataggagattttaatttttttctaaaattgaatactaacagatagctatctcttaaggtatctccagacagcctcagcaacaaaactatccactaagcatttaaaagaaaacaaaattgccagtaagataggatatagtatacctgagactatttcaacataactgtaaattaagatgaaaggaaaatagcaaaactatacttattgctcatcatcctgtacgtaaatctacatgaagaaatttagctatgaatattctacctccttacttacatccacataaagcatgcagatgacgtatttcttgctatctaaatgttttatgtgtagagggtgcatgggagctatctgcttcataatccagatttactctcttttttgtcatgttttaaatctgtttactttggaaattgaaaaattatcagaaaatgttctcattcagctagaggttatcttttactgcaagggacccctaggctgaaggttttaaaaaataaatagcttgagcaataatttcttgtagtgggataaagatcagtgatgaataacaaatctgagagtaaaagattttcttactctttatgctgaattacttaggaaacatgtgacattaggaacaaaaccctaacaaaacataagaaagcagattaattagtaaaagcttagatatacatacatatagaaaaaaatgacaaaaaaatagcaaaacacagtacaaataatgctataaaaatatacaagcaaaattaaagtttaaacattttgatgctatgaagatataacataacctttgctccctcactgtgtttttaatacccaaattcactcagagtggaattttacctgagacttaaaagcttgtagctctgcttgaagctcattaatctttgcctcttttttctgcaattcagcctgagtttcttggtggtcggtaaactctttttcaaactgaaacaaattaaaaataataacaaaaacaggaagatgaaaatgaaaagcactattcttcttatagaaatgtgactcgaatgatctgccggtagaacacaaattcctgaattggttttatgaaaggagtgatagagttttgaaaagtcacttacagtctttctctaggcccctccaggtcccaaccaaaatcgttcattcacaagggggcagaaaaaagccatagacaagtctgtgaccttctctctgcagagcaaactggccacagttatctgcagcattggcatttttcttcaaagtctctaaatattattgtgactttgtgtaaaataatagagagcaaagcattgtacaaattccttgcatcttccacctgcaaaaacttattcttgaaacttatctgaagtatatcaacatgatttagaggatttcattttaatattttttattactaaacaactccattctattcagtttctaactttttttcttgtaacaacataatatctcctgatatctttgggaaagtaatgataaattaatttttcaaagtccctagtgaaataccttctggaaaaaaaaggaaacaataaaatttggtgaatccagtgaattttctataataatttatatatccactcatcaccagttctcatcttgcattcaaacacattcaactttgccattattatgactaaaaacctcctttttgctcacaaacacaagcatttgactttcttaagaaaaatgaaaaaaaaaatcaatcaaaaaaatgcaactatctcacaaatgtggcctccacattttaaatacactcaaaccttaattaggaaaataacaacaatgtagaactccaccgtttacaaagggattttatttttacttagtttataaagggaatcttactttgtccttaataacactaagaggcagttgctagtccctcatagctagtaaaagatgtgagattaaaaagccagattccccgccttcagagtctaagttcaaatgaaactatgccacctccctgcaattaacgtttagataatgctttacggttttacttaacagactattttttggagcagttttaggttcacggcaaaactgagcagaaaatagagattttccacatacccccaaccctacacatgcattctctctccccatactttatagcttttgaagcataaaaagaagcattcttaaatttcattacaaaaactctgtgaaataagaaatactgctttaattcccattttacagggaaggaaggtaaatttcagactactgattctctcagtctcaacctgtgttcctttattaaaataacaaaaactaataggtaaaaactgtccaaatgtccttcagttgacgtaagccacagcaacactaccattccccacaactactacggctcctacaaacccctcttaccgttaaataattaaaaagattctaagcctatatctaatcaaattactaactacaaaacaagccatgcatgagtctcagaggtccgcccaccttctcctgtcacccagtgcttccccctaaggacttgctaaatcaattgccttcacacctcccttgcatagtttacctctctgtactttcatccctcattttactccttataaccccttaccataatccctctttagcttaaaagtcaactttttcaaagggtattcttaaaccacactcacttttctgacctgttgaactctgttcatttcattatctatcacacttagctataattcattctaaaaacgctgacttaccaaattccaattccagaagtccaaattccctggactgctctcagcctcatcttaggtgatctctctagggccatgctatttcaatatcatagccactgaccacaaatgattatgtaaatgtaaacttaaattatcaaaaataaataaagtttaaaaattcagttcctcggtcacaccagccattttaaaaagtacactatgggcacatatggctgatgactaccatgcagaacaatatagattataaaacatttccaccatcccatattagacaggccagttctatagcataaatacctacaaataggcctccatattcaacctcttttcctgtatgttccattacaacacacacttctggttctcctgctactccttgagtgctcctaccaattcctgttatgggtttctacaaaatccaacccactaatgatggcattctataggactctttcctcaccctcctcctgcttgtctcatcttccacagccatgtttaaatcaccatgcatacactgatggcttacaaatccctatcaacatctcagcttctcatctgaattccagactacaaatcagtccatgaatatatttccaaccacttaatgaaaacttttcaagacagacgaaaaaacatattttcaaaaccaaacatgtttccccctacaagatttgttttttgaatgttgctattctttgtaaagggcagctcaactaacatgacttctttgttcttaaactatcagtgacttcattataatcattactatctaagaaccctgtaggatctggccctaatctacctatttcccattacgcaataaatatttaacaacacacccgagatatgccccctcagagtggtaggttctgaagacacagttaaacagaatatggtcagtgtacttttagtcagcacagtggctgatggagaagtaaaagcaaactaacaaccctaaatcaattaaaaataccagcaataaagagagagacagagagagactgaaagctggggaatgattcctggaggaatgatgtttgacctcaaagtctgaaaaacttactagcatttcagcgtgtggatgaatgacaagcaatactttgtaaggggcacaaaaagaggtatgagaacaaactgaaggggataaagccagagatgaacacagaaataaaactgctgaaaggaattttgcaataagccaaagagttaatcctcttttcctaaaaatcctggagcattattaggtatgtataataagtaaacaacataatcaaatttttactttcaaaaactcaaccagcagcagtgtgaaagatgggctgaaaaagacatactagaggcatggaaattggtttggaggctattgtagttatccaagcgagaactgaaggccttcctgaattgaggtggaggagagggtaatgacaaagaaatgaaaaaagactacagaatccaaaaatgttagtatctgaccgaatgaaggaaatgagcgagaggagtgtatctaagatgactacagggttttgttgttttacaagctagaaaaaaagtgttgttatttggggaaaataaataaggttataaaatgcagggggaaaagatatttttagggagaagaaagataaatttggtttggatatgctcagcttgagataggtataggaaattcaaaagaaatttagatatgcatccttcttggctatctcgcgttgttcttcatactgattcctcaaggctcagattagacatcacttccttggagaaggcttccctggccacccatgactaggtgagggacctttcctctaggtttacataccacatagggtttgtctaccataccaattgcacactgtaatataaaattgtcaaaataacactcaccaacctgaaagctcataaatgtgagaaacttttctattttattcatcacctttccagtgtcttacatctataattaaagtcaaataaatatttgttgaacgaagtgatgagccaacctcgtcaaatcttcctttatatgttgaatgactatgtcaacatagtcactctcccagcatcagaaatctttgagaggtcattttctctttttgacaactaagacaaagttcactgttacacagcaagaaaaaaaattacgttcttatgagagtaagaatgaaaaagcctttctacaatatcaatatgtgaattatgaaatatctatttcataaatcctagactaaaattcataaggaaaaagaattatttcgggacttaagataaaaattataaaaacaaccacagtcataatgagtacattctaagaacatttattaaattaacttgctaatactaaagtaactgtattacttatgaaaaaataagtttccacatcctcgcctataaaaagatagctgaaatataaactttgttttagcatttttgtaatatctatagtcaaatcactgtagccttggggaaaaaatgaatctccattaaaagcacaccttataaaaactgatatgatagccttctccaaaaagagttactagagcgatattacacttacaaaattacatgcaaaaaaatgttgaaagacacagttaaggttgaggctctgcttaatttcattctctagggtgaatgtattagtgcatctgtacaagaaggttgataattcaatattctctatatactttctgacatttctggtcttcatttttcaaatttatgcaccaaaataaagaatgtgtctagcaaccatgatagcttcctgcctaaagcaaagtatttacatgtgtccttataaaactatcagaacaaagtttttgctgatatatacaaaatgatatggcaatagaaatattttatggagcaaatagtattttctgaatctaactaacacatataatttctgactaaaaggagacaagtaaccttgaacaaggtctttcttctatttatatatttaaaacctacaatttgtttaaaaatctgttgagaaactttaactccattcatgtttgactccattcatatatactatatacctaaaaatgataacaaaatcaaatttatactatctgggatgtatccaaatcaagtacttgaaagtctactactactttcctatgaagagttaaagtgcttatccagcttagaatacaatgttggctgggggaagggtcaccccacaacatgaacatctatccactgtaacactatgagactaaatttaaatgatccattaatttgtttcccccactaaactaagtcacttcagagcaacaacaatattatattcacaactgtaatcctaacctgcagccgaaggcgtgggaaataacaacctctcatttagcgtttggtaaagtcagaaccttaaggccccttaggacatttataatgttttacctaagttactcttaacttacaaaacagtgcctataatttgtaagttatgttttatcttcaaagctatagaaatgtgcaactgcctcaagatacatttagtatctgctacatcaaaaacctatactccttggcatgatgcctaacacacaggaaatattcacttcgtaaatgtttgctgtgggttcatcatggtgacaacagtagtaagaattatcgtcactccttcaatgtgaaaaaccacctgaataattcaaatcagattgactatttaaaatgcaaagaattggaataacaaattaaaagtctaataggtacttgctaagccagagataaaaggacaaaacaataccttaaatttatgcctactgttccattattggaacgctgagcatgtggaagttatttatatcctactgcttaaggtcactgccaatgtctgatttttcaaaactcaaaaaaattgcaatctcaggcataaatgggttaaagaaaagtaaggaattggctggatggttagaaatactactgagttgaaacaaaactggttttgtttgtgtaatatccaacagctatgacctatgaaaatggcaattttataaagttcaacttaatataatgaagcaactttaatcaaaactaaaagcaagttaacttttctcttaaaatttttatatatgatttcattcttaagggcttaatatcatttcttgagaattaccacaaccttaaaattttgattacatacattttgctccatcatccactcattcaaaaaggatctttttagttcttacaaagggccaggaattgttcctggtgcagggatagtgaataaaacaaacaaaatgcctcaaagtttactgttagggtgaaatagataagtcattcacatataaatacataaactatgtagcatgtgagatgatgataaatacattcaaagaaaaataaggaaagaagaatagggaaggtcaaggttgggagtggggagttaagactttttagatacagtagtcctccttggtggagggcatctatgcacacacctgaagcagataaagaagaaagaacgaataacaagcaaattccctgaggcagaagcatgcctgcagtggttccccacagaatactataaagttagtgaaaactacttactttcttgtaaagttctgatgctttctcttcaaactcttctagttttgcttgatctatgcaaatgtctaaaattgcaatgacaggaaatttttaatgtgaaacttcttaaactcattatgacttcaaaagtttagaaagaaaaaagatcatagaaaataattaaatactgatactaccagtaataaacaaaatggaaaaaatattataatgttggaatgaaaaaggcttttctaagcatgataccagaaaacagaaaacacaggaaaagccaaactcaataacaattttaaacttctagcaggcaaaaggagatgttcaattgtaataacactcaaatgtttctatcaccaactcgtacatattttaaagaaaaaagatgatgtctataaacaagcttaaaaaaaacagccaacagtaataaacagaaaattagaaaaattgatactaaaaaatcaccaaaacagatgaataaatgtttattattccctaacaatatgaaaattagcaatatgaatgtgaagattaaatgactgataatgccaagtgttggagttgacatgaggaaaccaatagtgaaagctaagaactttgctgatgaaaaactaggcaatatatactaaaattgtaaatatggattttcttttaacctagcaattccatttctgagacttggccattaggcctgaaaactcattaaaatattttttgatgttagacaaaaaaaaaaaaaactgaaaataacttaaatgcccatcaataatgaactgcttaaataagttatgatatatatacatgatagaatacaatgtagaagtaattcatatggatttcccatatgttatcccttcttttttattaaatgaaagcgatacatgaacaaagtttataaaaatatattacagaagaatttataataaaaaataagtcaacaaagttactgtatccaaatcttaatcacacttcctaaatgcaacctcttattaccatttctatactagattattttggtggttagtttcttaactgtaaataaaatgtacataagtattatttcttgatttatctatttaagacattatagataactttctattataaaagattaagacagtatttgttctctaatcctaatttttgatattttatttactaaactggattgctccagagcatgaaatatttaattttgattcccattacattaagaataacttaaaattcttgccacagtatgtcaaattatctgtgcctcatgctttccaataccttttctcccctattgcccacctttggttcttctctcacctattcatagaaatacaatgacattctcttctgtatttaaatcttttgtatttacttatgagattattctaaatatttaaaaatcagtaaatacaattaatttattaaaactacataagcacgcatcacttatacaaccaaatggtgttcaaatattttatttccttctcaagagctcagtgaaaaaaacctctcagctgccattcctaaatgacccagtggaatacattttttcagatactattcaaaatcattccacattttagtttgctgcatatttacagcaccattttcttaatttctgcttcctcttcccactccccccaccccaggaacttctaattgcttatctcttatagagagaaacaagcattttcattaatattatctagttcttcactaattatatttcattcttctcccaggactcagataatatacgaaaagaaacataaccctgcacagatacatagctgaaaatgagaggtgtattttaatagccttttcaaatcattgtgggtaatcttctttgatgttatatcgaaatctgacaaatggtgacttcttaaacagtagttacaatgtggaatcacatatcatatcaattaacttgtactctgttaccctaaaatctcttgataaatgttgcacttttaatagatcttttgcctatgcagaatttgtaatatcaggcactggtcatatggaaagaatggtgtgctgagtcatgcaaatgttccgaacgttaacaggtctttatacaatatcacaatgaataatcagataggttaataacaccagtgacatcaggaaataattttagtattgagaacctgtcagcctaaaagcagcagatacaagttttccaaaattcaaatttccacttaaaaactcaaattttctcattggcagcctatttatcggccattttctttgaagttataggctcactttatttcatttttaagaaagcaagtgcctgacgaaaactttaataaaaactcaaatgttacaacactaaataataatgctttatctttaaaaaaaaaaaaaaaaaaaactctcaagttatagaagccatcgtctgtatgagtcattccaagtttaaaaaaaaaaaaaaaaaggcttcgggggggacaggcaattctgcttgcaactcaattacacaaatattttcttattgaactcttttaatagatctttgcctatggagaatttgtaacatcaggcactggtcatatgcagcagaagtactgtatgtataaatcccatttgttaacacagaatattaaaacagtgtgtatacaagggtcaggctttaataaagttaacatttttaggaccttatcaaaggcattcttaagtaaaaaatggcagtttttgttgttttattgacagtaaagatgataatgactactcccacagtttagtgccactgccttgattcataacaaagtgccaggagttttactcaccattgttctgcaccaccagtgcaaaataccaacccaataaaaaaggcgaataatgtttttgtgctattatgaaaacagttttgacaattagggccctcaggagtccagagacacaacccgagaaccaatgccctagagctcattcatagaataagagacaataagatatttctatttaaataataaatactcacctacaaactgggttaaatctaaatctagtctttttcgatatgtgaagtctggatccattccatctctatgcaatacaatctgggatacacactcatcaattaatttgaagtattgttgcctaaaaccaaagaaaagagtaaatgtacaattgataattagtgtaactttacatcaaaacaaaactttttggctaagattgatttcaagttcaacaatttattagtaatataatttcaatagttgacacaacagattttacctgggagtgagagtaaatacaattgtcatcactttgcttttaatgaattcaaaacatcatttttatagtcttttaggaaatacagtatcccttaattttcttataaaagtcaaaaccttgaattaagtaaattagctgaaagtgaagtgataagtgcttaaaatttgtgctcagaggtcatcaactttccactgtaccacactgaaatagctatcattaattcacttcattaatacaaccaaaataaacaaaaattttctctaaaaagttttatgggagtatgtggtatactgttttccaagtgtttgtgaaatcaaatttaaaactggtactgtaagttatatataatatcaaattcatatttcttactcaaagggaaatagaaaaattcagtataataatatttgtccaaaaatcgaagtttaactaaaacctccaagtagatttcatgttgtcattacagttaagtctagtccatctacactggtcataggtgaaacatcccttaagattttgaaaggatcaacaaaattgatagatcgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggctcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtattggaagttctggccagggcaatcaggcaggagaaggaaataaagggtattcaattaggaaaagaggaagtcaaattgtccctgtgtgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaaaagaataaaatacctaggaatccaacttacaagggatgtgaaggacctcttcaaggagaactacaaaccactgctcaaggaaataaaagaggatacaaacaactggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaatggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgttggagaggatgtggagaaataggaacacttttacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacgtgtatgtttattgcggcattattcacgatagcaaagacttggaaccaacccaaatgtccaacaatgatagactggattaagaaaatgtggcacatatacaccatggaatactatgcagccataaaaaatgatgagttcaagtcctttgtagggacatggatgaaattggaaatcatcattctcagtaaactatcgcaagaacgaaaaaccaaacaccgcatattctcactcataggtgggaactgaacaatgagatcacatggacacatgaaggggaatatcacactctggggactgtggtggggtggggggagtggggagggatagcatttggagatatacctaaggctagatgacgagttagtgggtgcagcgcaccagcatggcacatgtatacatatgtaactaacctgcacaatgtgcacatgtaccctaaaacttaaagtataataaaaaaaaaaaaaagaaaaaaaaaaaagaccaaaccaaaaaaaaaaaaagttatttgagattagttgagcatgagtaggtatttattgctttctttttggccagaaacttgttagtgaaataaggctaatggtagaaatatttcctcttgtaaagcataatcatctcttcttgagaagactggttttaaaatatcctagtgcttttagatattgtacctttttggttatgccaaatattagttcactttggaaagccggtaatatgaaaaatgatgtcactcatcattagtacagaggattaaagagaaaactggaacaagaaagatgtctcagaaagggacaaaaaaaaaaagatttaataaatgtaaataaaacagataaaagattttataagcaaaaccaaactaaagtgataaacaggttgggtactattctaatgaagcacagtcctccatctcagatcatcccctagaacttctttccttaatgacttttaacatacttttcctctctaaattctaaagtgtgggtccctcaagccatttagactttcctttccataaactatgacccactgctcttgacctacttaccttacacctaataaaccatctattacagtgaagaaaatccactacagcttaacactagcaaagatgactaatgatcattaactgtcatagagtgaaaatgtttaagaaacggttcctgggtacaaatcaaaagtgttaatctatgcttgcctctatttgttcaagttctttcaagacattatctcccatccccaaatatttctgccataataaccacatttacacgtggtacatacatttaaacacatttacatctattacatttaaaaatctagatgatgtatttcttttctactcaacattattctaatgtttttaaaatgaaaatgttttaaattaacaacacaagctatttcatgtcatctttttaagaaatcataattttagtaagtttttcctcaactccacaatgtccaattatgagttcatctataatgtggctgaaatttcatgcaaaaactcactggggaggcaatactatcaaagaataatacacaacatttctggattccagaaatgtcaatctagaaaataatctccatgagcaatattggtgaggtagtaaatgtgtctgaggaatatgtgaataacttaattaagggatgaacattaagttgtcattactgacaaaatgctatttttgttggaggagtttttgaaatcttcacttttctctgtggtattgttaacaaatatcagaaattatctcccatgcgcatttaactagcgtggtattttacacatggtaagccttaattatttggtgtaaaactgaatttgatcttctccacccaattatcttgctgtatttcagccccctccctttttcccagggaaaaggggctgcctttgacatatattctccaatcgaattccatttctgtcaaactttcttttgtcccaaaagtggaaatgaaaaaagattctaatttttccatccaccaattctttcaaatgagaacatttaacattctgcaatagaacaatctactgtttgtaaaaagaaaaagaaaaattatgtgtgttcgtatcaaaagtagtttaaagagctcattaaacaaaaaatgttacaggttatctaagattgctgaaaaggtaaaatagaggtccttctgaggtagatgaaaccaaaaaatgaaggtaaaaaccaaaaaaacaacactcatagacgtgtacaccaacaagagtaagttttactgtatgtaaataaataaaattttaaaaaataaatgcatgacaaaaatatatgtaaattatcacaattctgacacaatcttggaataaaagcatattttaagaaatatttttaagaatttttttaagaaatttttttaaagaaatattaacaacaacaataataaataggagagtttggaaacatgaggaaaaaactgatggagttgtcttgagtctagcagtcacaggaagaacactgcctttgtggcaaccatatctggaatcaagatacccggggtttaaagagccaaagaaggaattaacataggtgaacatcaaatgtaaaagttcatactcaaaagatggccaaatatctaaatttctatgccttaatgtcattttggtaatgccacaatttaatctttctccaagactcttgatttaactcaaatgatagtatcacctgaacataacccaaaacagttgtgttttttaatctgttttgaagctagatacaaccacatgctctcttggggcacagatgaagggatcaaagtcataagtatgataaaacccctgcaggactacaggcatgttcaaaccattgaaaacaaacaacagtcttaaattcttgggtactcaaacagcatcaaacttccagaagacgacaggactgaccacacacagatcaaaaaatgtatggagtttactttagagtaaatagaagtttcaatgtcatttttaagtaaatttggagtagaaatatagtatcataaacagcatggtacaaatgatattttaaaaatctaaattagcaattcttaatctagcatttataatataaatatttaaactggtttatttttaataaaatatcagaaaggagcaaattaaaaaaatcagttactaaactcatattttagaatatcagtgggatttctggctacaaagagagtaattttgatgcatgtcctatcctcatcctgaaaaacctaaagttttaacattttgggtctcctccttgcttgttaggtacatcaaaaaatcactgagtcataccctctgatgttaccccgaggacacagcctgaatgaagcttgtctaaaaaactcttctacttgaaattaagtagaaaagaaaaaaacacccaaagtataagagaatgaaatttcagcaaacctaaattggtggcaacaaaatgattttatattcaaagagctcagcttccaccataaaacagtaatagaaatggaaagtagatatagagaacatttactaagcatacaccatatgccaagggtttggctagaacttttacccacattcccatatttcatctgcctaacaacccagtgagttaggcactaatctccatatttagtcacattataatgtagatgaggttaaaagaaagataaataatttgttaacctcagatggctaggatataatcaatctttaaaagccatttgtctggctttttgatatattagcaacattaaacgcaactgtattattaagacttgccagctacttaaacactaataaaagcaatgtttagtgcccttcatgtaacttataagaagaaacttatcaacatcattcctactgcctaagaaataactagaaaatattatctgtcacatgataaactagtaatttgttgctagtttgcatttttattcagatgaaaggttgtaaccaggaatccacaggagcttaaaaagtaatagtaatatcattttaccatcgtctacctaaatatatgcccagagaaaacaacacattctatgaatcagtgttatgacaaaaataaaaatcatttgcttgtcaaaggcaaatatgatgtgaatttcacaattaatagatttttattagtgaaagaaaacattagaatacaacttcctcttaccttataaaataatcatttcgaatcagcaaaagatgctgaagaatagaaataaaatatccctctgctctagtttctttaactgtgctccacaccatgttgtaaacatcatatgcttcagtgagttgattaaggaatatatggatttatttatactctacaccaaacaactataataatatgacagaatttgtcctgtaaggttttggaactgtaatacaggcatcttatatattcaacataaaatacagatatttaggattgagggtagtggaaaaactctggaaatggtgacttaacctgacacttcctgacttcccttctacaatcagttccaactaatctgtctcccctaagcacagatgctgttgggaacaaaggtagtagggaagctggctatgaatactgtgttgaattctaaaggttgcctgaccaacagagctggtggtcaggttaattatctaccatgaagaagccccaggtgaggataggaacctgttgggtctcatgaggagcacagacgtctgcagacccacagattaacatgcgacccatgagtatgcacccaagatgcagggaaagagcagccagtgactaaggctgccctattcctaatgctaaaaagccctaagtagaaggaaaagtgtcaaatataaaaagaaaacaaaatagattgcacacatacatataagaaaccaatctacagaatccatttgttagttgcagcatacgcttacatatatgtgtattcataaaaacacacaaattaataaaataataacattcttctgatgcatgaaggtttgatttcatgttgtttatatagaaatgagctaaatatttgtggctgagtattttggatttagcaataattttatatatgatttgactagacttcagaacaaaaggatattcaagttcagctctaatatcttcaaggcgatgggataactcaaacaaatcttcttctttatgctcatcaaagactttaagttggatatccaggccatcattcttaatgcattttaaattctagagatatgaaatagaaattatgatgaatgattttgtttttaattatgcaaaagaataaaaaacatataaacaataaaccaaccattcaacttgatttatagcattcgaacatttaaagtgttaaataacactcgaatcttatcatctatatttcaaaaatagattttttaactcaagccttttcccacagataaattattcttcaaggtaatttatctaaatttccccctactcaagtactcttttaatttaaatattaataaggagactgcagggcacttactggcaatatctctttcaatccacaacgcataaattcatttctgatgtgaagcctgaaatccaaatcatcaggagatgtaaccagggcattgatgagctgcatacaagctacctacaagagatcaaacagtgagacagactgggtttccaacattaaagaaagagtaacaaacgtaaacttcaaggttttgttccagcattattaaatatctttcctattaaaacaatttgtaagcaaaatatttcagtcagttataaactacagaagaaataaagtttcagtggcgttttttatttctcatttatttgagggttactgaggtgaaaggaagatggaaaaatattagccgttactactgctccataaaaaaatagaaaaaaaaaaaaaaaaacacttgtaaccaaaagctaagttcttgtccaataatatcactctacacacatacaacagaaattgaacatatccaatatacctattggatagataacacttacctaaaataggataataaaatagttttccattcatcaagagagactcaaagtcccaaagacttcaaggtcaacaagggtcttaactctagttaacaaggttataaataaacactgtataattaatttctagaagttaatttatcaggcaatggttctcatactttggcaaaaattcaaaattaccctatgttttaaccagaaataaataacagagctcactaaatcctttaatatatagcttaaatgataaaaatttttaaatcacaaaattttcagctcatgtttaacacttcaactttcaacttctccacttttttcatccctggctaaaatatatctttcatcctccaaaatccataaaatggaaacaaaagacagtctttctagagaagcattctttgttgttgttgataatactatttttctaaagtctacattctatccaagtctagcaagaactactggactactgatcaatatgtttaacctcatgctgttccctaaattgtcttttctccatcccttaaggcaaggtttatatgaatttaaaatgctgttttggagtaagacaccaacagaattctcaattcctgctgtttgaaatatatagtaattgttatatttgatatctaagcattaaaatctgaccagcatgcctctactgtcgaaacttaaggttgtttaaagtgggaatgggaaatatgtcagaagagagaggaagaagagaaacatacttaaaaaaaaaaaaaaaaaaaacttaacagaatctacctttccagtacatgttcattcagctgtaaccagttcatgtcaaaaagtcaagtttaaaatgttttccttccacccccttgccagtcattacccaggacccacaaatgttttcttcagcaatgccatataatttttaaagatctcaaagagcaaataatgcttctctacattcagagaaactaaatcaaactcagtcacctggcttctagaaaaacacaaattacagataactcacagaaagtagcaaaaacaaggaacacaaaaactagcagcaaatattacctaaatggaaaatacatatatgtagacaacagtagcatgaaatttagaaataagggaaaggataatccaaattatttccgggaactattcaaaaaggtgattctccatagaagaaaaaaaataggaaattaaattgaaataatgaattcaagttaaatttataaaattgcttcccaattctaatcataatttgccattagcatggcttacaatctatttaatttaaatcatgcaaacatgtctgtgaatacacataggtatgcactaaaatgcattgtttctttatggataaataattctataatcaaggtaaagaccaaggagttccttgtaggttttatacataatgagatacatacctgcggtatcacacaatttcacaataatttagcataccagcagaagggagtgtcaatcagcatttatgccatatcaatcaacgcctagagatatcgagaaacgttaaaaaactacaaaggttaacaggacattttgcctgtccaatgaagatatatcagtaaaatgataaaaatatactatatactgtaagaaatatgtttggtaaataatgggaatatggagatgctaaatgagaactaagacagctgaataaagtactaactaaaggattaataaaatggcctgatgaagaagtgaagaaggaagatctaagccgaggaattaacatgttcaaagacatggaacctttaaattacaagcaattcaaattttatgagcggtttgtcaaggtagaaaggggagtaacgggaagaagtcaagaaatgaggttgaacaaggagacaggagagagggcatagccttgtgtgtcaagtcacaaaattcagattcaaccagaaatagtgaaaatcataaggaattttatgcaacaggggcacaataacagaggcaatagattcaagttcagaagctgttgtagaagtaaatttttgagcaaggaggaaggttcaaacatttgaaatatgaagaaaaattgatagaatgaggtagaagaaaagcatttacaagaggcctcccacttttgttatttaactagatagaaagtggtaccattagcagacatacaaaatgtaagaagagcaacaggttttagagaataggataaatcctactttcaaaattctgattgagatgtatattagaatcattcattcattaaaaaaacaattactgactacctacaacttctgtcaactggagatactcatactcaaaaaatgagaaccaaaagtgagatgttcgtcataaggaagtaatctctgtgctctagttgatgttccaaaaatgtagcatatgatctctcttaatttgcatgttacagaaatcgttatgatacattacaaaaccaacctccctctgcgctaataagggtaagaaaacaaggaacttccatcttcttgagagcatctagttaactaaaggttccatcttagggcatcagaagcagtttaccccgatattggctcacatacttcattccttcaaagcctatttattgatgcctactatataccaggcactgttcttggtgctagacatacagctgtgaaaaaagatggaaatttctttgagagaaagaggagtcaagactgactccaaggttttgggcctgagcaacttaaaggatgaaattgtaatttattgaaacagaaatgaccacgggagaaaacaggcttgggaagagagaggaaatcagttttggagatgataagttggaaatgcctattagtgatctaaatcttaaaagctgcgaaggaaattgaagatagaagactccagttcaaaataaagcaattgccatagcaataatacgtaaaaaccaagacctcagatggaatcacgacagtatagaggaaaaaggaggtgtcagaactgtttagggcattttcaaccgtaggtttcaacatggagattagagaaataagttaaagaaaaagaaaagttaaaaaccataagtgaggtagaaggaaaacaaggagattgtggtgtcctggaagtatggaaagtggtctcaacagtgagagagtgatcaactgtgtcaactggtcaaataaaacaaggactaatcaattaccactgcatttggcaaaatgaaaacactggtgacttgacaagaatagtttctacaaagggatagagttactgttccaagcagaaactacttgcctccccacagatgccatatgcagccagtaaacaaacaattgctgtaaaatattctcctctttgccctaaatgcatctttatatgttagaagtaactgctcctttatctttgtttttaaaaagtctatgtaaagacacttatctctaggtgttatggattacaaattcaattctaatggtttggaaagccaatactgtaagctcactttattactcttgtgtcaattatcaaaaagggtcttctgtgagaaaaggtattttaaacgtaacttctagctggaggggtgtgtgtccatctatgattcaggatagttgaggatttccttagggcagcagtaaactaaaagtatagtacaaggactgacatcagcaaactccagacagcctaagactggaaagcgagcggccaaaaaggtaatgacaaagagtgggacaaaagtcagcaataccataaagtaggaaggtaaagacataacaggggccaataaagtagataagctgtaaatagaaatctcaaagatattcaatatgtggggcagagcgagtcaaaggccatcttaagaacagggcaaacgatcaaaggaaaatcattagaagccgaaagaggttaacaacaagatagaggaacatgccactacatctacatcactgaatcagcaaagtggctttctgcccttgaaaataaagtgagaagttttcttcatatgtgaatatatagtacctaaatttcctttggtacataatttactgcaattactatgttcaacacaaatatgagaaaagacaaatgtgtttatttgtacaaatttattgtacatgagaaatcttgttacatgcatataaggtgcagtgatcaagtcaaggtatttagggtgtctattccccaagtacaacatatttatttggtcagatacagtcactctattctgctatcaaacattaaacttatcccttctaccatatgtttgcaccctttacacacttctcttcatccttcctcctctgcccccactcactcttcccagactgttatctttccactttctacatccatgtgatcacaatttttagctccaacatataagtgagaacatgtgatatttgtctctctgtgcttagctgatttttcttaatagcctccagttccatctatgttgctgcaaatgacaggagttcgttcctttttatggctgaatagtattccacagtgaatatgtaccacattttctttatccattcatccactgataaacacttaggtttattccatatctttgctattgtgaatagtgctgtaataaacacatgagtgccagcatccctttgaaatatttatttattttcttttgggtggatactcggtaatgagactgtttttttctaacctttggttccctgacccttttttggacaacaaacttaagcacaaaattcaaggttcactaacaggtactatccctgagccccatccacgaggaccatccagtttttccaaaggccgacagagcagaagctttcaacctgattgcgctgatgagatttagaaagttgtctaatagcaaaagtaagtagttcttagaaagtttactcttgagtcaacatgttcatcctgggtataagtagatgtttttacaattaaatcgtggctctacaatgcaacaacatatcagcttcaggagctaaatccagattgaaaacaagaaccagtaaaatacttaaataaaaattctatcagaggctgcaaaagcttattatctgggcctggaagatacagtttagactgctattcatctttcctaccccatagcagaaatcatctgtctctctttgcacaattaaatttcacatttatcaagttaaaatgagtaaatgatgcttatggagaaatattttgcctctagtgtaaatagagaaattccaaagattttaaaattttatacacatgcattgaagtaactgcatataccccacattgactcagagaaataaaatgcaggactcaagaagctataatttataccagggatactaaagaacaaacttgaattcttaaaatatttatttgaaaactcccccaagacatcattaatttcttctatgtcctcccatgcctttttctaaaactgcctttattgcaattttcgtatgaaatgttagatggctttaaattcttgagtataagcttcttaagggcagaggtgtatttcactcaactttgtagttccaatacccagcatagcccagtacctagcagtcactgaataactaagtaattgatcggttaattatgaaactttttagttaccttcaagacattaattatctttctagttgtccactgtagaataaatgaagaaatgtattatatagacttattaggtagattcagaaaactgccagtaaactctagataatgataaccattagtttatacttgggtatgctccatatgataatatgagttcacattagaatattatctgttcctttaatgtctactagcatactggcttattatttactgatccattttaatatggttgatgttttaattgattggtacttatatatcaaccctattcatgcaaacctcaataaaagtagtagtcagaagagaaaggaattaaaacaaattaacatttgcatccttccgggatagctcaacaatgatcctaaaaataagccttttactaatagtctgtattcttcatttagtccttcactaaatgtgagaaaagtttatttaaaatagaaaattaattaataattatttgatggaacagaagagacacttaaaacaaaaaatagtaaatcaagatataactgtttattataagacctttacttggtcttgggcataataaaacctgggtaaactttgaagattaaagtggtaggtggaacaaaatcaaccaaagcaaatatacttggctaaatccagaaaggcatttaacctctaatttgttttaatgtgagtattcaatggcatatttgtctgattattgcccattgacaaatttcaaaatatagtgattatccctcacttaagaaaggtttttggtactatttttgatactttaatgaaactatttatataatgataaaaagttatcctttttaatttataaaaatattgctttttctactttttcagacatggaaaaatgcaatcccatcaaactttcaaagatctatcttctaattaaacttaatgaaatccacagattgaagagtttttttttaagttaaggaaaaatttaactatctttgcagcagccataacaatgcaactctcagtctttgactgcaggaaacataaatggcctacagccccagctgctaccttctgaaagctatcacagcatttgaattgaagtcacagttccctgctcccagccaaggcttgagcacagcaagtatactaaaatagacctgttcctgggacacatgggactttggctcaaggattccccaacaggcttgtcaagctctcttagaatttcagggcagcctgagacactttcaccccatctccactccttcccactctccttcacctagagtcagatctgcattgagtttgacagttctcccagcctcccccagctcctcctccagggtctctcacaggcatttcctctagtcccttacacatcaaacctcttgcttctcatagaaccaagactaacagcctcatttcacaatgcaagtttcaacaagggttatcattttcaaattgtcagactcataagtattataactgaagcttaatcaaatttcttattttttaggtatttaacagaacacttttgctttttcttcttgttctttatatatgaccagcttctgtattttcatatgttactatgagatacgggttaagaccatgtgtatgccagacactgaaatacatttggaacacagattttctctagtaatatttccagagacaccaatagcctggattatattccttgcttttgcttccttgaaaaatatattctagggtagagaaatatctaccacaggaatcctagaaagacataccaaccatcaatcacccctgtccagtactgcatcactgttatcaccatagcttaagaagcctgaagatataagggttgcacaacaatgtgaatgtgtttaatgtcactgaactatactctcaaagatggttaaaatggtaaatttcatgttatatatatcctaccacaataggaaaaaaaaaaacctaaagcaaacaatggctatgtatttcaacagtgggtaaagaaatgacaagatctgggtcatctttactagataatcataacaagtagagatccacagaaggacaacataaacccagctattggtattatatctaaagagtatactaaaatcagatatttagaaccctgaatgaaattaagtaaaaggatttaagtatatattttaagtgagcaagctcagaactaaagatgctacagattcacatcaaaccatcaaagacaaccaaacaattttttctctctgaaacaagcttcccatcttttcctttatttgctctctgacataattatttctcctctctggactcagaaactttggaaatcatgttttccctttattcagtaactaacatagggaaaatattcttgaggtatttccaagaatcaaaattaatgagggtttcattccattcaatctacatccaagataaaaccaatgtataggaacaacattagaagaaccgggctaaaggaaaagtagccaaggtgacactaggagatttgtggtcttctgtctgttgcaagacaattctccctgggtctctcatatttcatttccacttgtattgcaagtaaagacattgatggtctttgatctagatgctcttcaaggatgtgtgtatacaaaacaatcttggaaaacagcatatctctccagagcaaagagcaggctcacttcatgtctagtataataaagataatgtcttttagagcaaagtgcaggcaagttcaaagttcctctcctacagcacatcctgccatttaccaccagaaagttctgaccatgatttgattaccattacctacactttactaagaggtcaatcagaatagatccagctcctgcatctcccatgcaaaacatcttcccttctctctggatgtcaaccccattccaactcccataactgtagctcagtcattctgtggagtgggtgaatggcactgacaaaaaggaataagttggactgactgtcttcagacagtccctccaaaaattgttagacttaattatttcctgaaccaagaactgtaaaatttatcagccacctggaagccaagttgaaagctctgccaccctgtagtcccttaactaataaagttcctatttgggtagtcccaacaactacaaacaacactttccttccaggagcaccatgtacacctttcaagactatttatcttatgtgaaagacaggcattaacttgcctctctcttcaaaaacaccatgacttgaaccctacaggtatgatcataagaaatgttcaagtgtttaaagaaatgccaccagtatgtcatgcaactcttaggcaactatggagttctctccaaatggaagctatgcttagttactctggggagcttcctggagaaaaaaactgacttactatgtgtactctgcaggcagttatccctacaatgggaagtggtaaaaaatctgtgcctgatttcagctaaagtgatcagtgacaccacatcagccctgggaggcaatcaggtcagcttcaactcactgaccaggattgttatgaagaaagaattgtcctagacttctttgctgaacaaggggaagtttgcgcaatcactaacacatcatactgtatctgaattaacacctcgggccaagtggaaagatgaatcaaaaaatttaaaaagaaagccacctggtgttctaaggtagactctgatgatttactggattatgggatttgttcagctgactagatctgggacctggaaggcaggactgaggcaaatacttcagacaggactcattctgctgcccacagtctctcctgaacttaattaagtatgctatgaaacaaactgaacagatttcatcatagcctgtatcaatcagatcaattacagtcattgctgcccataatataaaagtaatattccctatgctcaaggtttctctcctaaaacacaacccactgcaactggcagtattcacattacactatgagtgtcacaatatgggctttgggactgacacaaagctgatactcagcctactgctattgctgtgagcaataaaatcctttgtttttaacctaggagttcacgtcttttgacagcaccaatagaactatgacagactaacatgtcagtttacaagtggcagatcgtctaagaccattcatgttcctgaccctcccatcagcaacttcatgggtactggatcagggagaaaccacaggaaaaggaagttacagcattctatcactgcagacctgaggacatatacacagaagaagaaccaaatatccacccaaaatgctctaggattcccatgttttggttcccttccaaaaatatatcacaattcaatcagtcgtatgaccaacagcaagggtttcaacaaactctttgaaatctagaaaatgctcttgatactccaggaaagtatgaccctgacaagagtagacagaagacacagaaaggaaaagaaaaagaggagagaaataaaaataacagaagattaaaggacggcagaaactagagattggttaaccaatacttatcccagtccttttctactaaggaaaaactggccaacatgagggacaagcacacacatgaacaatggacactacgatggagggtttggttctcctggggcaactgtggcagaaggctgtctgtccctggtgtcacaagtgctgaccacagcagagagttgggagtggcacttccattagagcattgctgtgatacagtgcagcgtatcttctgtattacttctagctacagaccacccacatgattccctgggcctaccagaaattttgtaaggtaggtacaaaatttgtgaagtaattaattgatataggctatgatgaaatctgttcaatttgtttcatagcatatttaattttgtaataacattttctgcttaaattacccagagtgattatgttgcttgcagctgagaaaccctgtctgatgtttgaaaaaaaagtaatgtatgcttattttaagtcctagatttatatttgtactttctttcctgataatatatatgtatgtgtgtatacatatatatatagatatatctatctatctatatatagatagatagatagatatagatatatatatattttttatgagatggagtcttgctctgtcagccaggctggagtgcagtggcgcgatctcggctcactgcaagcaccgcctcctgggttcacgccattctcctgcctcagcctcccgagtagctgggactataggcacccaccaacacgcaaggcaattttttttttctttgtatttttagtagagacggggtttcaccaggttagccaggatggtctcaatctcctgaccttgtgattcgtctgtctcggcctcccaaagtgctgggattacagacgtgggccaccacgcacggcccctgataatattcttcaaggcctgagaataaagttattccaagtacaaagtttaacattttcttactatataatatcaaatgggggaagtgtgcacaattctatcataatcataaacaaattatcattattaggatcagaataacaaaaaagtaacaattctccttattctcctttaaaaaaaatactttgtcataaatatactttgcagtaaaagaataatgaagaatgtgtttattttgctatctcattttctccaatttaaaagtaaacaattggttcctattttattcaccaataaacaagttttatttttaattggcgatttgctaatgtcatctagtttagcacattttaataatgcaatttattaaaatggaataaaatgggtacaaatagttttataggaaaattgatagccagccacctcaaaatttactttatttgtggaaaattcagaaagacagagaaataggtatttttagatattactacaatttttagaaagagcataacctgcaatatgcagaaaagagtatctatgttacctttttttgtttgtttggcctaagttagcactatagaaaatggtatcttttactctgaagcctgctacctgctagctatttcacacattaggcttaaaaacaatgagaaacctttattaaggagtaaaagccttcaacaaaatatttgaatagaaaaaataagaatgtaaaacaattctttccattttctattcccaattaagagcatggaaatttaacctgaacatatcagaaaaatgagaaagaaataaatttgaatgatgctaaaataatctttcacttcttaaaaattaagctctaagaactatatcaagaaatttattttagtgtttacaggatatcaaataattaacactactactaactgtaacagaaaatataattacaactaaagcaattagtttcataaaagcaaatataatcagctacttatatattggcaaaaatttttcaaaaattgaatcatcacctactatgtcccacaaaaattaaaaattaaaaagaaactgtatcattcccgtgacttccataactacggaaggaaaacattgctctaagctctcctcctccctacctctattcactcaacactaaatatggcaaataagcagtagtttaaaaagaaatcaactccacaaatgttcacagcagcatttttcataacagccaaagagtagaaacaacctgaatgtctgtcgactgacagctgataaaatgtggtacactcatgacagacgattatgtggcgattttttaaaatgcagtactccaacatgaacgaacctctaaaatattttgctattaataagtaaaaaaagccaatcacaaagatccacataatgcatgattacatttacgtgaaatgtctggaatatgcaactctataaagacagaaagtagatcaatagttgtctcaggctagagagaatcaaagattgtggagttatagctaagggatggggactttcttttgggtggcaatgaaaatcttctaaaattgactgtggtaaagattccacaaagctgttaatatacaaaaaatattgaatcacactttttttcttttttttgagacagagagtcttgctctgttgcccaggctggagtgcagtggcatgttctcaactcactgaaagctccgcctcctgggttcacaccattctcctgcctcagcttcccgagtagctgggactacaggcacccaccaccatgcccggctaatttttttgtatttttagtagagacggggtttcaccatgttagccaggatggtctcgatctcctgacctcatgatctgcccgccttggcctcccaaagtgctaggattacaggcatgagccaccacaacctgacctgaaacgcacattttaaatgggtaaattttatgatacgttaatttagtctgactagagctgttaataaaagaaattaaacctgtatcaaaactttatataaacagaattcttaatatttatttaagtcttaatatcttctatagaatagtaacctataaaatcccaaacttttaactgatagttctctttctagatatttactgactaaatataagtttatcatgactatagaaatgttatttttccacagaagagcaccttcaataaaagcagaactacctataaaagaaattacttaatttaccccctaaattttttaaatcaacgtagtttgccttcaagttcatactcatcaatttaatttgtagttaattaaaataaaggtcagatatatttacctttatgtctaacagccaaaacaaatattccaaataaccaagaattagactgcaatagtcgaaactttccaataaatgaggagatcatgtcatttaccaggacaaaacagggctttgtctttaacaagccattatttatctcttcccttacagtttaaaacctcatgtaatgtaatactgttgtaaacaaaaggatgggaccccagttttaccaatattttcataaaacttttactctcaaataattatagattcatagatagttgcaaaaaaaaatcagataaagtaatggttcaactttcctctacaaagttttctttagggctactcttcattaatcttcagatgaataaaaagcctgggaccagatgacaaagaaacttgttcaaagcaccagatgacagcagatcaacctgacaaggaaagacataaaaaatagaaaggaaaaagaaaagcaataggaaggaaaaggagagcagggaagggggagctcagagatgaggtgggagagaagagacaagaaagcaagagaaaagaaaagaggaggagactggaaatgaggctagcagtacatgaattaaaagactctagtctctcaagcaactaaatgggcaaggtcgatgtcacagatggggaacacatcccagacctcgaagccaatgtcatctaacaagcccagaatgcatgaaaaggggctctcttacagaggttcctgcaggacccatgccatagagaccctctggtcagatcttcaatcctgcctattcgaagagaaccaaatcacaacatagggttcctcactggctattcactaacactgtcatctgaaatgtcatactaaattattagtttcacagctcctatcatattctcattttttttttttcttgagtcagagtctcgctcagtcacccaggctggagtgcagtggcacgatcttggctcactgcaaccactgtctccggggttcaagtgattctcctgttttagcctcctgagtagctgggattacaggcacctgccatcatgcccggctaatttttgtattttagtagagatggggtttcaccatgttggccaggctggtcttgaactcctgacatcaggtgatctgcctgcctcagcctcccaaagtgctaggattacaggcatgagccaccgcgcccagcctattatttttaaaataccatttgtttacttttaatttttcactttatttttttatttcagatttagcttttctattcctaatataccaagaaacaataaaatggccaagcacccagaacctttaaaaaaaaactataactttttacttttattaagtgtgaaagagatttacttcatatctattaacacattggctttgaaactttgctgcacgttaggatcacctgaggatcattttaaatttcccaatgtccaggtcacaccatgccaattaagttttagaagtacggaggtgagaatcaggtattagtattttttaagatgaccacttttgaacaattataccaataaaagcctcttttcctttttttaaaaaaagaaagagaaattaaatgaatattattcagcttgaatacttaaatgtttaagtctaaatgtgtctttttagcagtatttttggaaacatctataaccttgggtttccttattattcacgtaagctcaacttttcagttattaaaacaatgaaaagccctaatcgacctaattggcaaaacatctcaaaagttaaagtaatttaagagactaacatagaataaacagttcatagaactatgataatatctcatacagggaaatctaataattctactacacgaaaagcaacctaggaaataaccattgttgtgtgccaagatgtatctataagataaattatgacacagtacaaataggaattctatattctaaaaataatgctaggccggacgcagtggctcatgcctgtaatcccagcactttgggaggccgacgcgggtagatcacgagatcaggagatcgagaccatcctggctaacacaatgaaaccccgtctctactaaaaatacaaaaaaaaattagctgggcatggtggcaggcgcctgtagtcccagctactcgggaggctgaggcagaagaatggtgtgaacccaggaggcagagctttcagtgagctgagaacgcgccactgcactccagcctgggcgacaaagcaagactccgtctcaaataaataaataaataaataatgctataaaagaatattaaaaggcatgcagagcttcataacaatgttttcatataaaccaatcataaaaccgttaaaagtaatatatgccatttaaaaacagattttatatacacacaaaacttacttgcagttgaactgaattgtgccggaggccttccacaatacaaaaaaatctgtcaatttttttttcttcaccagctgaagttaaagcttctaaaacttcttcaaggctattggaaaatttgagtcaattaaattgcaagtagcaaacacaaatgccataatacaattgctttatcctactaaagaagtcaataccctaagcagccaatatattttagaagtagattactgagtacataccatgtatcaagcacagttctaagcatgttacattttaatcatttatccctgacaataaccctgtgaagatgtttatcaagcatttatataatgcttactacacatcaggcaccatttaagccactttacaaacatcaactcattttaaagtatataacaattgtttgaggtaggtactataattaacccgtattatagattaggagactaaggcagaaaaaggttaagcaatctgtccaaggtctcatatctgtgaaatggtggagcaagaatctgaaaccagacagtttatgtggtgggcaccatataaatgctctcaaccactgcactcttatgcctcacaagtttaagtaaatgaagctgagtgatagtcgaaaatatataatagtatggtattataaatattcaaatataaaatataataattatgcaaaaactatacttcctcttcttttaagtaatagttaacagcatccagcacactggagaagctcacagttcgtggacatgggcatgcagtcctaaatgttacttacaggatcttgatacccattctgaagtcaagaaacaaggaaaagggaaggataacagaatagggaagggaaaagaaaagcaaggaagagtccaagaggaaagaggaggaagaaaagggaaaaagaggaggttaaaagacagaattaaaaaatgatgggggaaaggggaaaggaagaaagtgggaagggaagctcagaaagtatcatatgtccacataaatttcactcttagatttgtacaccaacatttatatggccttaaatactgaagctgtatgcctggctttgcacgcttgggactgctgctgggtgtggcaacacctcttctatagataaacactgtaggcacactttgcgggcagactgccaggctgaggccgagtggtgtctttgactatccaaccatcaagccgaacctgctcaatcccaccaactccagcaggacctccacaaggctgattttcaaacgaacacaggaggctccccttacaggactctgccaacccctacatatgggggatatttctgttagttcttttgcctgtttagtttttacatttttatcttttttaaaaggcattttaaataatttttaaatgcttcctgataattagaaccctaatttttaaaaatctttatctttataattatctttaatatgtatgtaatggtatttaattatactcctaacaaatgtggttaagttctttacagctctagtgtgtgctttatgctcaaggactttgtaccctcaaccagtaaactactattacataaatcactttctaatctgccttatatatagatttccaaatcgtaatatgtttgcttttacaaggggatagagaagacctacagtttgaaataattctatgtggggaaaaaaaatcacataagaaatagaaccatttgtatattttcaaagcctccatttagaattttttttaatttagggtttcagttaaaaaaacagtttaaatatgataaggaaatcagtttttcatagaagtatgttagaccataactaataaatcaattaagagaaataattactcaaaaatttccagccaataagaaactatattagctgcttaaatatacctcaacatttatttaaattctagtaaattctagcctagagtagataatgaaacattaaatgaatcaatctgtattaaattattatataattaggggaatatgttgataacacttacatgctttcttcccctacaatgcataccgcagagagaagtttaaccacatctgtcatcatattggggtgtctgggatccacggctttggccaataaggaaaggctcctctcctcactcataattctttccaagccatactataatattttgaaaataagaggtcaaatgttagaaattagttagaaaaataataccctgaaggaaatgtagttattaaaaaaaatttataggacatttttacacttactaaagctaaaaaatatagactgtgtaacactctaaaaagttcatggctgggcacggtggttcacgcctgtaatcccagaactttgggaggcagaggcgggcagattacctgaggtcgggagtttgagaccagcctgagcaacatggagaaaccccctctctactaaaaatacaaaattagccaggcatggtggtgcatgcctgtaatctcagctactcggtaggctgaggcaggagaatcacttggacccgagaggtggacattgcagtaagccaagatcacgccattgcactccagcctgggcaacaagagcaaaactccgtctcaaaaaaaaaataaaataaaaagttcataagggtattcactttatgtcaagaaccacaaaactaaaccaaataaagataactcaaggtgatcttacaacaatacagctgacaattattaagacaggttaagtagccaaattgagaaagtgggaagcagtcagaaacatgggatttgccaacagaagcatatgaaacaaacagccagatacggaaccagacactgaggccatgaaaatctttttcctgggaaggaaggttggtaagagatatattatcataagcaaacacacagatcaacactgtccaagagaaatataatgtaaaccacatgagtaatttaaaaatttcaagcaagcaaaactattttcaataaaattaatccaatataccccaaatattaccatttcaacatataaccaatataaaacatttattgatgacatttcacttctttttcttcctaaatagttgaaatccagtgtgtattttatactgtagcacatctcaattcagactagccacacttcaaatgctcagaagccacatgtagctaccatattacaaaatacaggcctagatattagcacttagttcataaataagcaaaaactgaaggatgatttgagcagataccatgtagaaactgccacaatgggcacaggtattctaatcacaatggtatttattataaggaaaacaatgcagttgtaaactcattctataaatgagacgattgggattaggataaagtttatttactactgccaggaagtcaaatccaattagaagataagttatgttaatgatgtatctatgaaagataactgtcaaaatacagaagatgaatagaaacaataaaacagtactatttatctagcatgcatctcagaggatcctactaaagcatgagaactgactaatcagagttactaccaaacactaaaaaagggccttattcccaattacaagcctatgaactaaactcaaaatcagcactacatgtaagcattgaagttgaatctataaccagcttagacccaagtactttgattgtgataaaatcctatttataactttcctatcttgtatatggccatttatgcaaagaaaccttgtactgggctgaaatactccatttactttaaaccactatctgagaaacacaggaacaatggagaaagtatgaggaaaggccaagggcccaagaatatgaattttggagagattactctgtcttgttagtaatagggaaaagtttacaacaagacagctaaacagtcaggaaatacttacttttatgatagcctgggctattacctaactggaaaaagaatgaaaaggcaggcacaggaccagaaactacaatatgccttgctaatcattccagggaattgtcaggtttataaagtaccacttagattcaattcagaaagtcagtcaatgattaccaagtacacaagagctggctctgtcctaataaatctgggaattgagtaaagcttgcctctagcatttccccttcttttcccacctacctggttgtccttagctaacacctgcccttctagaatcagaatcctgtgactcctccagccacccaaggtgactcatgctgacttcctccaagtgatactacctgccttctctgccaaaccctctggccctaacctatcatgtatgaaaggtgaaataggagcatactctgatttcacagttttaaccatcatcctgtgaccccaaaagtccatcacaggtaacgttctctgattttggtaatgcaaaaatgtgtcacactcattttaagactggaatgaggccaattactactactcagtatctataaatacagaattgctacttgtataaattactctcaattatttaaaaaacatagcaaaacaaaacaaaaactgttgactctgtgtgagaagttgtcaacttaccagtgctcggattaaagtgcatttaatgagggctgttttaggttagagaggcatgacaaattttgaaaggtctaaggatgtatctttcctgaatgtcaaggacccactccggacaatatggtaactggcctgttctaaactgaggatcaatgccaggttccgcctgcattccacatgaggcctattattagctaatagatggaatttcaggcactgaagatgatgttttaggtagaggaaagttaatgctctaaatcctcgtgtaggacgcccaacatctggacgcacacagcatgactactagtgctgagcagccacccacagtgagttaatcccagtagcagaaataatgtggttaaagttgctggcttcagaagcaaagcacccgcaccttgggtgcactcttcaaagcaacacacacagttaactgaccaaactgaagtctctgttctaattacctttcaatttgaatatactaacttttcatccttattatcttttctttcccctacgcaattaaaattctcttccatttaaaaaatactcttagtccaatttaatgttataagaaattcactttcatgtaatgttatcaaatttgcccattaattgtataattaattactagtaccaaataaggtaccacatttttttcctcttaaaacttatattttcaccattcaatgaatgctaataaagactgtataagtgaggtttaacaaattttgtacttatagatgtgatcaaataaagattaagacaaccattaaccaatcttgaagggaaaaaaaacttcaccaaaaatttcacatattgctaggtttagagttcagacactataatactaagtaacaataacttaaattaactttttattcttaataacacagataaaagcaccaaataaaatggcaatattttatagctccatgtatataaactacaagcaacaaaaatctcttaagagaaaaatagtatattaattagaaaataaagttcaatcttcctcagattcattatgaaacaaagtaagaatattatcttctatttaccaccttaatttaaccatgatattcttcttaaattcaaattatgatccaaatgtccctttggtttaaaaaaagttcctagattttttctacttttggcttttccatcaccaatgaaatttccaatttctatattctcactttaaaaagggcttcctaaaccagttctatgtacttagtgggcaaagacctctccctatcagcaatttgattctttcattcatttactcttaaaacagatatgtaaaaagctaccttatatatctaatatctgattttcaaagaaccgtgaattcagcatagaaaggagttgtgattcctacatcacatattttctttgaaaataatatctgtttagaggaggcaaggaagaaaaaatatttcattggttaaaaatagaaagcttagctccagaaaatgcttaaaaatacacagtttaacaagacaaaaataattagaaaatataaatatttgctaatacatgtagtaaaataaatataaaataaatcaataatttacgtactagtacttaagtgtgtagccctataaaagtttgtttttaaattagaataaggcaaaatattataattaaaattaatcagaaatatacagatgcttttgctataaaacaaaaataatcgtaccaccacaggtaaaatttccccccctgctgtctaacagcaacttaaacacctatcatcacttcacacatcatgaggtaaatgtgtttagatgctggagcttaaagaaacagcataggataatgctaatttctacagttaacagtataaaagcaaaaaagaaacattgctagataaacctaaaatctaacttcagtaaagagcttaagaattcctctttttttctagtttttttgttttgttttgttttgttttgttttgttttgttttgtttaaggacagggattcactttgtctcccaggctggagtgcagtgattcgatcacagttcactataacctcaaactcctgggctcaagccaccctttcatctcagcctcctgagtagctgggactgcaggcatgtgccgccatgcccagctatttgttttactttttgtagagatggcgtctcactatgttgcccaggctggtctcaaactcctagcctcaagcaatccctcctgcctcggcatcccaaagcggtaagattataggtgagagccacaagcaggtttctcccttctaatgtaacctctttaactatgcaaattcctccatattacgtttattctcaatattacttgggttaagcctcattgctctatttctgagacctgcttatatctgtttacattaatttcattgtagattttaaattcctagaatataagaaatcttcctaacttgaacctttggtaataagtattattgcagctcacatttaataatcatgatcttaaagctgactcacgccgtacttttgagagttaggagagggaggaaatgaaggaaggaagaaaagaggaagagtaggacaaaaaagcagagaaagggtggtgggtggagagaaaaaaagaaagaagatggggttggggtgggcagggttgagagggaggaaagggtggggagagataattaacctatacatgaggagttcagcaccagaagaggtttattcattatcaagtttctcctattgcaagacagttgaaactagaattcaataaaattcaatatttttccatcatgtactaaaaaacacatcagaacaatttaccatcactttactgcaactgaaaatcatatattacaaaattggtgacggacaaatactaattacgtatgtacatacctgcgtattcatcagggcttttagacactgtatgactttatgttgatttttctttacaactttttcttggctgtattgacataaaaaatagcagtgttggaattataattggacatatgaatgatgcttacttgaaaataattattagcaatacttacatttttccactaatcagtttttccaaaatgtctaataataatccaagcccttcatgtccaaagctttccacccaactgaaaaacagaaaaaagacagttacacattgtcagtaacgcagcttgtgttatcatattatatacctacaagtattttatatttgctatattcctaatcgtaactaaaacataagaataacaccatatataaaaattattcatgactcatcttagttgtgaaagaagcaaagatggatatgccaatagtgtgctaaactccgcttgcacaggcttgtaagagcagactgtgcccatctcttccatggttcatgtttagggacatcacgtgggtagcttgaaatcagccacagtgaaagtattcacaccaaagaaactggcaaaccaatcagagcctcccccacccacgcacccagagctggctctaaacatttaccagcataccactaattacagcccatttggggctatgccaaagaagacaaattgtacaagtgagtaaagatctatggaggaaagatgtagatcaacataaagaaaaagattactggcaaaaattaattaaaaaaaagagatgctttagcagaattccccaaaccactgaaatacattcctacaaatgttaagaatttcctaagtttcaaagttcagttgctttaaaaacaaacaaacaaacaaacaaactgcatcactgggttttaaatgagttatctccatgttcaccaaaccaaacctgtcccataaacccactgacccaatcacaggcctttacataactagaacattactgtcactagacaacagcttgcctggattacatgaaaactacctcgctagaaatgaataccttttctcagtggagattagtaaacctaggccaataaataataacaatgataataatctgtcaccaaaagaatgaaggaaagaaaagatatatgtgtgtatatttatttgtatgcctgtacttatatatgtgattttatatatgtgtatgtgtactgtttgaacagtaagatgttaaaaacaaaatttcggccaggcgtggtggctcctgcctgtaatcccagcactttgggaggcagaggcgggtagatcacctgaggtcaggagttcgagaccagcctgaccaacatggtgaaaccccatctctactaaaaatacgaaattagccaggggtggtggtgcatgcctataatcccagctactcggagaggctaaggcaggagaatcacttcaacccaggaggcagaggttgcagtgagccgagatcgcgccatcgtactccagcctgggcaacaagagcaaaactccatcacaaaaaaaaaaaaaaattcaaggaatgaaaaacagaacactataaagaataaaaacaagcttaagtcatatatcagaaaataccaaaatatcattttttcttaagatacaacatttccagtgaaaagagaataaaaaccaaatgcaacatatttatataaaaaatacaaatattgagtaaaatccagcttcttcatttgcatatttctgtaaatacaacttgacacctatcaatgttgaggatttctgattttacaaaaaagaaaaagaaatttgccatttagactggcaatctcttgtcagacaatattttactcatctcttgccagtgaaagccatgaaataactaatttttaaaatgcacttaaacaggaaagatactctcttgtaaaagactgaagattgctattatagttaaggtaaggaaaaaagttaaacagaggttgttttcaaaccaggctgctacttcaaaagtgaagggtttactcttcactatcagcgacacacagattatctgtaggcattttgaatcttgtttttatgtttcatgaaaacaactacagcatctcacttaactgtttgccttgttgacatcctattctgaatttattcctatttcacatgcagcagggaagtgaggagaaatctgagagttttacttgggctgacattgagatgcatggagagagactgttcataaggcactcctctttaatacttcacagagggccttcaatattttgtttgaagtaagttttcaacaatatccatattcaaaagtatagccacaaagatattctaaagccaatataaatggtttcagattattcatactgctatcacctttaatcattgtgaagaataaaatcactgttcatcaaactgcctcacaccaaaataggcaaagtaattttaaattatgttaatataacaaaaagactttgttacacttaatatgcttatattatgacccactataaaatttaagaaacacaaatccatgtaaatcagtaagttctctgatctacataattaataataaaaaatagctatttaaaatgtattacctttaacataattataactagaatagtgtgactcatagatggtctaaagtcaactatttctagacccactatataactctcttctaaactacagaatatgaactattcaaatagaatgtatgcctactcatgtattttatatataaactaattctctataaaacaaaacttattaaagttccgtgtaaagaggcattaaaccaaatcacttcatctattacaatcttttaagtcactgtgggaatttctcaacaacaataaaatgagagttgggcaatggccttctgaaaaccagattatacattatatctcataaaacatgtcaaaaacaagaaaagtgggacagggtacagggaaagaaaactgagacacctgacaaccaaagaaacaatataagaattaaaagaaagctaacaaaagtacttactaaaaagattaaaaattaaatatgcataaaacatctccctgttttcttaaaaatttgcaaactcaacatactgttgtattaacaggtgtcactcacaaagcaataatctcaagtgtttcaccctcacccctactattttcagcaatattatttttaaagataggggtatgaatatcacttcctatttccactggaaaagatgttcaagataaaaagtgatattgagtaggcaggtctgtagtcttgacagaggtttattgagatccatagctttctacaaaaatgaaaaaatttctcatcatcagtgtaagaagcaacctagaaaaaaattatcaactgatctataaatgattaatttccacgaactaaaatctgcactatttgttctatgcctgtcagcacagtaccatcaggcattatgtggtttaactataaactgcattcatggataaatatgcacgtttcttcttcatgaatagaaatgacatagagatcagtatgacatttgtatcagaaaaaaactgctttaaaacagcaaccgtagtgtgctaaatactaaatctacctcttaaaattctgtaacaggaaatattaaactcttctaattgcttcaaggaaaacttctaagtatattacccttcagcatttcctagtaggggtctcaatataggagaaaagaagagatgaagaggtaataaaacttaataaaaattaaaaaaaaaaaaaacagagggagagggagaacaggttcccagaattacaatgtttaacccgcctttaaatgttcaaaagcagcttagactttgaaattcagttactacttccagaaacacaggatgaaactgaaagtgtgtaaagtggtttctgacatgttgttggctttaatacagaagtaaatacagtcagtcacctcattgagcaatagaggcaacaatcaggtctcagatttacctcctggccaaaaggaacaaagcgctctcaagtatttttcccaaagactgatctcctactcttcctttgttttgtttaaagttattacctttcttcccagatgtgctcgtagaaagggaaagacaaatgcatcatgaattataatggaattaatcttggaattattacccttatgatctggaataaacataccagatcataagagcaatcttacctgatgcatactccttgagtatagggaccgtttcttatatatcatatttattccagcatgggatagactgagcactcaataaatcattttagaatgaaactaagtccccttctattgttacatataagaggttatagtcacttagaaataatatttaggtctgctgataaccaggcttgtggcctttatatatgcagaaataaacacaaagagatgacagatctccacaccattactgaacctgtctcaaccttcaagctagaaacttcaattgcaatttcagaactgttatttgcccatactgaatcaaagataataaaaccaaagacagggtcttactctgtcgcccaggctggagtacagtgacacaatcatgtctcactgccacctcaacctcttgggctcaagcaatcctcctgcctcagccttcctagtaactgggactacaagcatgtgtcaccacattcagctaattttaacttttgtagagatcgggtctcactacgttgcccaggccagtccaaactcctggcctcaagcaaatcctctcaccttagcttccaaaagtgctgggattacaggtgtaagccactatgcctggccaagtcagcctttattaaagggcacactgtattcttgatactgcactaggtatgagaaatacaaaactgaataaaatatgttctctgcccttgaaaagatcacagaccagtggttgaaacaaatgtcgaacaaaattatttccataatgcaataaatgctatactcatggtgctctgggaacagaaggtacaatatctacctctcttgggaacttcaaagcatctgctgtctgacctgagtctttctttctaagcaggagggcatatgcacaaagacattaaatgtaaaagaaatggcctgtgctgagcaacagagaaagctgtatcagagataaaaccaaacaggtaagaaagggcttgatcttgaaaaaccacatatgtaatgccatgggcaatgggagggcataaaaggactaagcatgtgtagtaaagagagtaatcctacccttgcccaccaaaagatctgcacatcttaaactcagaacatatgaatatattacctcatgtagcaaaggagaaattcagattgcagatggaattaaggttgctaatcagatgattttaagataggaaaattaccctagtttatccaggtggttccaatctaatcatgtaattcttaatttcccagcttggttagagagatgagatgaaagaaagagagtcaaagcataaaaagggatgggcaccctggctcacgcctgtaatcccaacactttgggaggctgaggtgggtggatcacttgaggccaggagtttgagatcagcctggccaacacggagaaaccccgtttctactaaaaatacaaaaatagccgggtgtggtggtgagtgcctgtaatcccagctacttgggaggctgaggcaggagaatcccttgaacccaggaggcagagaatgcagtgagccaagatggtgcctgggctccatcttgcccagacaacaagtgcaagatggttgcccactgcactccagcctgggcaacagagcaaggctctgtctcaaaaaaaaaaaaaaaaaagagcataaaagggactcatcttgcctttactggttttgaaaatgaaggaggccaaagaagagccaaaaaatgtaggtggactgaaaaacctgggaatggccgtcaactgaacagctagaaaagaagtaagaatcttaatcccacaaccacaagaaattgggttctgccaataacccaaatggacaagcaaattgagttgagtctcttattcataaacactagatgtctccatttatttggatcttctttaactcctttcatcgttattttgtagttttcagcataaaagtcctatgggtaattcattagaattacaattattttttgagcaattatgaatggtattgtgtttttaatttcattttctacaagtacattgctagtacatagaaatacaattttatatttttatcttgaatgctgcaaccttgctgaactcagtgataagttctaggagtttttgatagatttcttgagattctctatgtaaacaatcatgtcatctgcaaatagggacagttttatttctacctttctgacctgcatgcctttatttccttttcttgcttcagtgttctacctagaacttccctatggtgtaaaacaagcgtcctgaaagcaggcatccttgccttgttctcaatctatcttagagggaaagcatttagtctttcatcagtaaatagaatattaactataggatttttgtagatctctttaccaagttaagaaagttcccctctgtattagtttcctggggctgcaggaaactgaggagtttaaaaccacaaatatattatcttgtagttctggaagcaaggtgttcaaaatcaaagtgtcagcagggctgctgcctgggactctgggtagaatccttcactgcctgttcctagcttctgatggaagctgccaatccttccagtcatcagatgggactcttcctgtatctctgcctttttcttttaaggacacaagtcatactggatcaagactttaccctactcctttatgacctcatcttaattaattacactgcaatgactctgtttccaaaaagggccacattctgcagagtgttaagaatgtaaatacatctttctagggacacaactgaattcaccctctattcctacttttctgagagttttcattatgaacaagtgttgaattttgtcaaatgctatttctgcattgattcaaatgatcaagtgacttttcctcttttgcttgtcaatataatgcactatataaggatttttgtatctatactcatgatgaacattggtttgtaagtttgagggttttggttttgttttgttctatcttggtactgtattggtctggttttgctatcaggtaattcaagcctcattttaaaaaaaaattaattgctgtctgctctgctattttctggaacagactatggaaaattggcattaattcttctttaagtttgtggtaaaattctccagtgaaatcacctgcacctgaagatcttttggtggggagaaggaacttaattatcttaatagtcagagggccatccaaattatctatttcatattgggtgtgttgtagtttttcaaagaactgatctagttcatctaagttgttgagttgtatatttaaagttgttcaaagtattcccttattatcctgttgatgtcttggtaatatatcttgtttagttcatgaaattcgcaatttgggcactgctttcaagatgtttttatctatctttggttttcagaacttttttttttttttgagacacagtcttaccctgtctcccaaactggagggcagtggtgcaatctcagctcactgcaacctctgcctcctggattcaagcaattatcctgccttagcctcctgagtagctgggactacaggcacgcaccaccatgcctggctaatttttgtatttttagtagagacagggtttcaccattttggccaggctagtctcgaagtcctgacctcaagacacccaaccgcctcagcctcccaaagtgctgggattacaggcgtgagccaccgtgcccagcctagttctcaggaatttgactatgatatgtctgtgtgtgaatttctttgagtttatcctgtttgtgattcagtttaggtaggtttatgtcttttgccaaatttggggactattcagcctttttttttttttttttttttttgagacagagtctcgctctgtcgcccaggctggagtgcaatggcacaatctcagctcattgcaacctccgcctcccgggttcacaccattctcctgcctcagcctcccaagtagctgggactacaggcacgtgccaccacgcccagctaattttgtatttttagtagagatggggtttcaccatgttggccaggctggtctcaaactcctgacttcaggtggtccagccgcctcagcctcccaaagtgctgggattacaggcatgagccaccgtgcccaccctattcagccattatttcttcatgtacttttttatcctgtcctctttctcctctcaagtctccaatgacaagaatgttagatctttggttatagacccataattccctgagactctgtatgtattttttcccaatctattttttcctggtggtccagactatatactttctatcattctatagtccagttcactaattctctcctttcagcctcatgtttcgcttttgaggccctccagtaagctttttacttcagttattgtatttttcacttctaagatttacatttggttctttaaaagaagaaatagtttcctgtatttctttgctgagactttctattttttttcttttgtcagcacattcctatttgcctattgtaacacttttatgatgactgctttttaaaagattcttgtcagataattctaccatctctgtcatatcagtgtgtcatctattgtcttttttcattcagtttgtgattttcctgcttcttggtatgaccatattttttatactgaaggctgaaaatttgggatatcgtgttataagattctaaatcttatataaacctcttatttcagtaagcttcctatgacacagctccagtggaagaagagaaagcaccacctcattactgcaaggtggaaacagaagtccaagagagattctttgttaccacttgacatggatgggaatctaggtactccctgatggagagaaggaggactgcctcattatgctcaccatgtaacctacaatagcaccatggaagggggatgtggacgtctgttatcactgggtggttgtgaaagccctgactctattggcttctttggacataatgccagtggggagggggaagaatgcctcattaatgccatctgtgggtagaaatccaggctacccactttgctttttgatagtgtggtgggggatggggccacatatttttttctgcgatatttagcagaaatacaaagcagttattgccaacattttctgtcttgtttgctgccatttttgtggtcctttggtttcagagagaaggcttttgttgggacttctttgttctgtgcccactgtcacttctgggttactgacttcttcacctccaaatctgacaaaaaggcagaaagacaacccagcaaactcaccgccatattgtttcttaaatctcaaggttcctagcctgtcttcttatatttgtttcacatataatgtccagtatttctagttgtgcttagcaaaaaaaaaaaaaaaaaggaaatagtagatttagtctatctttcaaacacaagtctgaaacatccactgttagagtgtgagaacaggcagaagctcccaccaagaaaatgagaaaaaggcagtgacagtggtaagaggagaaccaagtaaacctgacataacaaatccaaaggaaagaagaagtttcaaaaagagaagagtcaagagtcaagtgctaaaatgaggtcaaagaaaataagggctaaaaagaactataaagaaatgaattcaacaacaatttataaataattctgtagaagtgaaatcctgattgcaaaagaattaaaacagaaaaggggtagtaagaacaaagaaaaaaacataatttgggattaaagagttgatggaagaaatttgtaggaggactgagatgaggacaatttaaaaaaaaactgtgtgccataaacactattacaaaaataaacagagaatattagaggagcaatgaagatggctaccacacttagctagggcctaggaacaaaaccaaacttaaagaaaaaactatgcctacaatcttgaagtggaatgatgctcatatatcttaagtttaaaaagcagaaatggtatataaggcattttctattattattcttaaatgtttttgttcacatataagaaatgtatgtacatatgtgtagctatacaaacattcttaatcatcctccacctagtcagctaattcaaggcttgagttctactctcttatacatccccacacactgctcccaccagaaccagttgggtttctttccaaatccattcctgacagttgtacctactattgtatttatataattaatattatataaacagataacacataattggggaaaggggtactttttctatgaaaactaagcgtaatgatttggaaagctaaaaatagattactttttaaattgctgtagaagtaaatgtgggcacaactatatattaaagggaaatcgtagtaccaaaaaaaatttttttagcagaagaatacttctgcattcagattgctctgccagagcctttatgatcctgttcttctttaaagcaccaatatcaggaagacaacgcattatgagtatgctttatgcaatcagcctttgcccactccaagaaaaggtctgggctccatatgaaatgtctacagaaaaaaatgtttatgctttagattgaaaaaaaaaatgtttggggtatatttgaatcatttatttgattattacatgctttaagcaacttttttaaccaaccaaccaacggtattagacaggaagacttcctctgtagacaaagtgtctctctctctctctcctccaagaagttagtgtctatttaagtagataatattatacatttttcttgattttgcttttgcatattttcttattgtcctataatgatcttatcttttttgtaataagaaaaatatttttaattacccaaaagaataatcttacatgaatgcctagggaaacacaaatctagatggtttaaaatcaatacacaaagcttcttaaaaggagaaaaaatacattactgctcacatgtgacaaactaacaaattttgtaccttaaacttggaaggtcagctttaatactgtataatatctagatccaatttacattcttctgtcagagtaatatatcaccaatgctgaatataattatagcttattttaagctttcattttcacctacctttaccaaggtgactaaatacttaaaatgaacagttctaggagggagtacaaagcacttagcatgccctgtggggcaagacaaacatacacctacatgccattcaatggcccatccacccaaattacactaaattacagagcaaggctgggaattcaggaactattataaataatgttcagattgtaaaatctactaaccttcaaaatacaaccactaatatgtatattttcttgaaatatacttcttaaagaaactgtatatttaaaaacaatcatttattcccacttttcatatcagataagataacacagtaataaatgtagtattctcctagtttctttttggctataacatactgaaaggcataaaatatctagagaaagcattccaaataaaatgaaaataaaaccaggttaacaggaatgataaaaaaacaaagcacaagaaacaagagttcttgacctttagatgaaaaaacagtaaaacaagtatggattttaaaacatagatactggtatgtgctctaatcaaaacttaagtccactattaaaaggaacatattataaaaaaggaaatatcttatttggaatgtgttaaatattagtacactaatatttaactaaagggcactaccagtaccagtaagtagtttcttagtatcaaattaaacatcattagttcaagaaagcactaaattattcattttaaatatagactaatttgccaacaatatatgtggaaaagacgttatggtcacatttcaggcttttcaccgcttgtccccaccctaaatacttgtcactactacccaatgctggtcagagcagtcctaattattaaaacccatgatcttcccttgattctataaatttcattgctacttttgtgtggcaatgcactcataatgctcccctccacagaactgcctttgtaacaactgaaacaatttcagctttcaaggccaattcacatttccttcttctttgaactctcgctgatttgatttctccatgtgttcaccaagttccattcacttgacctcagatacccctcaagttagttcccatttctctcctttcttttatagcaaaaggtctcaaaaaatttcatcacaagcatggtcagcacttcttgccatccattcactcaatctcatttcagtctggcttctaccaccaagactccaaaaaaatctattttctaaaaggacgccaacaaccttcctcttgccagttccaataatatcatcttgccccacctcatagcagcacgctatgcagtttgtcactcccttattttgaaacactcttcctttaggtccagaaaccagcatttggggttctcctccccactggctactcctcagtctgtgtttctgcctcctcttccctttctggatcacctatttctggacactttctgaacccggagtccttcagaacttgttctgaccgctcacctgtatctttagcttccttctccatacaacctgcccacactgggattgcatccattctcaggacttaaatatctccactccacatatgtaagctccagactcacacatctaggggtttgcttgatgtctcaaattgtgatactcttttaaacatgtcaaacttaacatgttaaaaagggatatttttggccgggcacggtgcctcacacctgtaattccagcactttgggaggccgaggtgggcggatcacaaggtcaggagatcgagaccatcctggccaacatggtgaaaccccatctctactaaaaatacaaaaattagccaggtgtggtggcatgcgcctgtagtcccagctactcaggagcctgaggcagaagaatcacttgaacccaggaggcggaggttgcagtgagctgagatcgtgccactgcactccagtctggtgacagagcaagactccgtctcaaaaaaaaaaggggggattttttttcttctccaaaattcacggaacaagtaacaacctcctccaccccaattaacagcactactatctgcctatttgctcaagtaaaaaaaaaaactgttattctcgattcctccttttcattcacatcctacatccaatccaccaacaggtcctacagtttccacctccaatttatctgcaacattcacccaccccttggcccaccactgctacaatccttatacaagccaccctcctaattcatgtgactactgccagagcctcctatctcacaccttcttgtccactctctcctcccttcaatcaattctccctaatatgatttgggtctctgtcaccacccaaatctcacctcaaattataatccccataatccccacatgtcaagggcagtaccaggtggaggtaatgggatcatgggtgtggtttcccctatgctagtctcttgaaagtgagtgagttctcacaagatctgatggctttataaggggaatttggcatttgccctgcttccactcactccatcctgccaccctgtgaagaaggtgcctgcttctcctttgccttctgccatgattgtaagtttcctgaggcctccccagtaaagcagaactgtgggtcaattaaacctctttcctttataaattacccggtctcaggcagttctttatagcagcctgagaacacactaatacacttcctgtggcagttaaagtgatccttttagaaagttaagccagaatagctcatctcctgcttgaaactcttcaacagactccacttccacagaatgaaaatccaataaccctaccacgagctttatggccatgaccttccgcatggcctggccactgcccaccttctctgacagccttttggattccaccatcctctcctctctccatccctctgccacacggtttttccacctcatgttcagtactactgcccactcttctctaaactagttccttgtcctttggtgtcaaactccaccacctcagaaagactttctataatcagctaaatcaaaaaacctctccattaattactctcagtcctcattttttcttcactgaactgattatacctttttgttttatttatttgtgttctaggtttctctctcctatatgcttctcttttactgtggtacctagcatagcccttggaatacttgttgcatatatagattacaaaatcctgtgctatattttagtggcatgttatccatgtcacatacttaggaacttaagagctttattctttcacatgttagatgtttctctctaaaaggaatcgcaacaatttaagaaaagaaatccttgcacctcatctagtattccaaacagagaatacataaaaacacttgaaatacctgctctcctgtcttgcaaatgagcagtacaggctcatgtattttactttatttcaagcattaatctccttattctgtttttactattcaaatccatttaacatgtactctgatcttctctcctgagtcccatattaaggcttcacaatgatacaataccgggtcccctcctcagaaattcatagcacagtggagagagcagccacacatatagactcaagagtacaaaggctcaaaacaagtgcacaagaaatgtttttctgatctctaaagatgtgttgtccaatagggtagcctctagacacatgtggctatttaaattctgaatttaaatcctaatcacactagcaatatttcaagtgctcaacagccacatgtggtaagtagcttctgtaatgaacaagacagacatagaccatttttgtcattgtagaaagttctatcaggcttctgttcaaatgcgctaaacttctacttagccctgcagagggactgcaggtgatatcagtggctctaacattcttttgggtgtttctttcatattattgtattaggccattcttgcattgctataaagaaatgcctgaggcttgatgatttataaagaaaagaggttaattggctcgcagttctgcaggttgtacaggaggtatggcgccagcatctcctctgcttctgggaaggccttaagaagcttctaatcatggcagaaggtgaaggggtagcaggcatgtcacatggccagagccagagtgtgtgtgttggctggagagggggtggggaggcaaacttgtaaatgatgagatcttacaagaactcactcactatcacaaagacagcaccaagccatgagggatctgacccatgatccaaacacctcccccaggccccacctccagcactagagattacaattcaccatgagatttgggtggggacaaatatccaatctgtatcagtctgccccaagcccctcccaaatatcatatccttttcaaattgcaaaatgtgatcatgccttcctaatagtcccccaaagtcttaattcattccagcattaactctaaagtccaaagtgcaaagtctcatctgagacaaggtgagtcccttttacttacaagcctgtaaaatcaaaaacaagtcatttacttccaagatacaacgggggtacagatattaggtaaacattcccattccaaatgggagaaatcagccaaaacaaaggggctacaggccctaagcaagtttgaaacccagtagggcagtcattaaatcttttttttttttttttttttttttttttgagatggggtctttcgctttgtcaccaggctggagtgcagtggcacgatcttggctcactgcaacctccgtctcccaggttcaagcaattctcctgcctcagcctcctgagtagctgggactataggcacaggccaccatgcccagctaatttttgtatttttagtagaggcggggtttcaccacgttggccaagatggtctcaatctcttgacctcatgatccaccgccttggccttccaggcgtgagtcaccgcacctggcctgcagtcattaaatgttaaagctccaaaataatcttcttgactctgtgtcccacatccaggccacattggtacaaggggtgggctcccaaggccttaggtagctctgcccctgtggctttgcagcgtgcaccacccacagctgctctcagatgccagcattgagtgtctatagcttttccaggtgtagggtgcaagctgctggtcaatctaccattcttgggtctgaagagcactgaccctcttctcacagctcaactaggtagtgccccactggggactctgtaagtggtccaaccccacatttccccttggtactaccttagcagaggttctatgtgaggattctgccagcccctacagcagtgttctacctggacacccaggctttctccatatatcctctaaaatctaggcggaggctaccaaacctcaactcttgcattctgtgcacccacaggcttaacaccacatggaagtcaccaagacttacagcttgcactctctggagctgtggcccaagctgtaccagggccactttgagctaaagctggagccggagtggcagggaagcagggagcagtgtctcaaggttgcacagagcagcagggtcccaggcctggccctcaaaactattcttccccaggaggcctctgggccagtgatgggaggggctgccaaaggtctctgaaatgtcttcaaggtttttccctcatcgtcttagacattaactcttggctcctttttagttatgcaaatttgtctagcaagtagttgctccacagccttcttgagttcctctctgaaaaaacctttttctttgccacatgggcaggctgcaaattttccaaacctttatgctcttcttcctgttcaaatataaatttctttgctccaacattggaacataggcaattacaagaaaccaggccacatcttgaatgctttggtgcttagaaatttcttccaccagataccctaaatcactctgaagttcaaccttccacaaatcccaagggcagaagcaaaatgcagccaaattctttgctaaggcataccatgcatgacctttgctctggttcccaataagttcctcatttgcatctgagacctcttcagcatggatttcactgtccatattactatcagcattttggtcacaatcatttaatgagtcgcaaggaagtttcaaactttcccttatttcccatattcttctgagctctccaaattcttccaacctctgcccatcacccagtaccaaagttccttccacattttcagatatttttacagcaaatgccccactcttttttttaccaattttctgcattaagcaattcttgcatttctataaaaaaaaatctgcatctgggtaatttctaaggaaaagaggtttaattggctcatggttctgcaggctgcacaggaagcatgacaccagcatctgcttgccttctgggtcggccttaggaagcttggtggaaggtgaagggggaacaggcacatcacatggtgagaccaggagcaagaaagagagtgtgggcagaggtgacatacacttttaaatgaccagatctcatgaaaattcactcactattgcaaagacagcaccaagctcattgggatctactcccgtgagcctaacgcctcccaccaggccccaccttcagcactggggattacaattcaacaggagatctgagcaagaataaatatccaaactatatcaattattatttatgaaatttaatatacaagaagctgaaataaactgtacctgttcctttcagacatatactgcccctctaataaaagaactattaatccatcatcaatctaattgacggagttttactcttaaaaagttttctgaatgataaaaattaaaacttcttctattgtcaatgtgatgccttcctttgtattaaggcctttcttcatgtatagatatgtaagggaataccaagataaacatcatcattttaaaaatcttttacttaaccgacttggcaatactctaagacataataacaagcccagaaaattaatctaaggaataaactatactgattctttgtatgtagagtactaataactagaggctttagtatctgcagtttaataatttctctcattgaaaatatttatctttcaacagaaaccaaagaaaccaaaatattcagttaataacttcatactgatagctgtaaagccataaacacataaggtttacattctcagaaaacaggcattaacaattaaaaagaaagaaagtttattatattctacctttatatccataagaaactgtaaagtttaatgagtttttttttccaaattgttttggtttaacactctaccttctgttgttgtcttttaaacagtaaactgatagtttcaaataattaggtttgttttgttttgttttgctttgctttaagaggcagggactcactgtgttgcccatgctagagtacagtggctattcacaagcacaatcccactactgttcagcatgggagtttaatctactctgtttctgacctgggccagttcacctctccttgggcaatttggtgatctgccgtgctcaggaggtcaccatattgatgctgaacttagtgtggacacctgattggcacagtgtaccacagcccagaattcctggactcaagagatcctcctgcctcagcctcccaagtaaccgggactacaggcatgtgccaccatgcccagctcaaataattaggttttagttacattttctccccgttatacttaagtatcagtaatatagggtacaaaatctattttttaatagagtagttgaatttaactaatctagacatacatgagctctcgtagttatatgaaactgcgttaaaaatgaagattttggattctgtgtcacattgtgactcactttacatgttaacagaattttttttaaaaagtcaatcttggccatttaaacagctatattttaaataaactgggagatatatatggcagatatatataccatatatatgtatatacgccatgtatatatgtacagcatatatagatatagatataactttaaaaaatagatttggagcactttacaattccaggccctctcaggtcaactataaattgagctgagtagctcttatttaccatctatagaatacacgtgtctgttaaaagcaattaataaattttccatgtgctctttgtttactgttaaccctgtattcaaagccaaagcttttaagatacagatacactttgaaaccaaatatttatacaacattttgctacatctataaaccaaaaaaaagctatagaatgaatgacggtatacaaaagaagcagcctcctacccctagggaacattcagtcttctagaggtctcttagagaaatggtgctaggtttggaaggactgtgaaagcatgagaaagtaatggcttgtcctttgaaaatgtaaagttagtacttatttgaaaacattaatagttactttcttccacgacattttttcattaatatttcatcaatttgacatgcttttagaaaggacagccacatgacttaaaattagaaggtattttcaacaaatatttatttaataagcaatgctacttgtcataaacattacaaactctgaatggcaattaagaaataatagaaggcatatttgaagatagatggcagtgtcaaaacaataaagaacaatattaataacctacctaatactttttgacttcttattggaaagtaatcttgaaaaaatgcctttaagaggtacaagtaggcacatctctctaatgaaaactctgtttaaaaaatgcatcccgctaatatttttaatttaccagagatgtttctacaacttctatgatgtactatattgctgattccctcattccagctacaggctgttacaccgatgactgccagggaccataactatagcacttcctgtcagacatacttcacctctccttttctattccttaatacctggtataaagcccactccctcccttagcctcatcctgctaagccagcactctctgctgaagggaaacctccttagatcactcttctattcccttgggactctcttgagattaatgtccaatcatccttgcagattttaaaaaacaatcttcaatctgtcagtgtttattttctttataatagtctcaccatctggaatataacattgagaatgtaataataatgtagttaatatatcaaagaagtggatatgcagaaccaaggccccttaggcagcactgtctaatagaattgcttacaatgacagaaatggcctatatatatatattgtccaaaatggtagccactaactacatgtggctctcaagcaattaatatgttgttgtgtttttttttcattcatttttagttaactaaatttaaatagccacaggcagctagtggctaccatattgaataacaggaaagaaaacagagctgcctgcattacttacctccgtggtatcaatatcaaagagaaaggaagaaaagagagaaagaaaaacaaaggaaaggaaaaagagaaaagaaatacacccaataaaacctttactccacctgcccctttcagaaattatcactactagtatcaaaatgaatctgaatatatcgttaattatcaaacactttttaacctaaggtgaatttttaataagtttttataacttgttaatctaaaattctaaaacatgccatgcaaatctaaaaaacatatccagaatggagtagagagagacaaataaatgcaaagtattaatgatagaataggaaataataaagtatagagcaagatggtctaacatatacaaaattagaggggaaaaggcaatacttgacaaaacaatggcaaaattttcacagaaagatacccatcatattcaaaaagccaaagaaaattccctatcagaataaaaaagaaagaaatctcacccagacacgtaaaagaaactctacaacaccttaagcatagatatctaaaaccctcaattgcatctcaattgcatgccctaggaaggctatccttccaaagcaaaggcaaatagatattttgagacgttaagtataataacaaaaaaaaaattgtgggtcaacctgattaaatatcatttttaaaaaagatattttcaaacagaattttgccatcacactctcactaaggaatcttaataatatacttaaagcaaaagtaaaataatctggggggcggggacaaaaatcaaaaagaatgatgtgtgtagaaacatatatacatatacacacagttataatatgactcaataatagtaaaatctaacttattaaaagaaaacagatacactgaaatttcactcaaaactagcatacaagtgaaaaaagattttaaagtattctttggttcaagagaagagatattgcttacttttgtacctttgaagtacatgcaagttaaatttctttttaaagtgtgttcatgttaaatttcttttctaagattagaattagattagtaaatgaggaaaaataaaataagaaattaaatatcaatccaaaagaagttaaggagaataaagaggaaggatgaatatagaaaaggaagaagcagaaagaagaaatgaggaggagcaggagcagtttggatgatgaacctggaaaaagtagcataaattaaaaattcaaaatgaaacatcagatataaattccaacatattttcacaattgatacaaaaagttaaaactaccagataaagacaaagattatcagacgggataaaaaaattattcatatgctatttataatagatattcctaaaatacaaggtatgaaaatgattagttgggaaaaatgtaaacagctgcacacatcaagatggataaatctatgaaacaatattgagaggaaatacaactctcagaagaatgcatggaagatgactggttaacatacagttcaaaaacatataaaaccaaacagtaggttaattaggaatatgtatatactaaaactataatagaaaggaatgataaacccaaaactcaggatagtggttaccacagaatagtagggggaaggggtgtttaggaatgaatgagggtataggattaaaaagggatgaaaggaagcttcaaagctataggcaatattatatgtctcagcctcattagtaggcaaggagatgcatgttatattgttatgacaaattgtcttttggaaatgtttaatatctaatttaaaaatttaaagtaagtcaaagtattagcaacttcaaatttctgatcttgaaagacttcctcagatcatgttgataaaaatgagtacactgatctcactgcttgtcacaagtttttctgtctttacacatgtgacttatggtatgaactagatcaactccgaaatcaagatgttccacctgctttgtgtttttaatcccagaaatgaagaaaaaatggattccaaaaacgacacttattaaatggaataatgacattcaaaggctgtttacttgttttcacgtaaacacatacatttctgcaaaattttccaaaatgattttctcaaaattatagttatcaacttaagaatctctttagaaatctaacaaaaagataactttatgagaaaattattcttgttaatttgaaaatgaaaattttaactatgattaatggaaaataatgcctaaaatttcaaaacacaaaaacctgataagcctagattttgagacaaaaaatcttacccttgacaggcacgtcaaattaagaaaataaagataccttctatcactaatttgctatatgcatagatgagtatgatctataaatgctgatatcaatcaaaatgatgttgctgtctacctttttatgtttctacccaaatgtattccataattcaaacataattattgactatgtcaagatccactaaaaataatatttgataatttgaagaaattggtcttttccctggtgttcagaactagctcaaaactgtcaccgagaatactagataatcaataaataacaaatagaagatgtttgtgatctctacatcaaatcttcataaagcaaggcaaataatctagtatttagcatactgattttcacataattcatagagagtaaaaggctgacatggctcacaattgctaggcagtttcagaagttgaagagtggctctaaaaatattacatatccagagccaagaggggagagctaattgggagtacagaggagtctactttttccttgatttctttctctttttttttttgagatagagtctcactctattgtccaggctggagtgcagtggcatgatctcaggtcactgcaacctctgcctcccaggttcaagggattctcgtgcttcagcttcccaagtggcagggagtacaggcatgcatcaccatgcccagataatttttgtatttttagtagagacggggtttcaccatgttggccagactggtctcaaactcctggcctcaagtgatccgctcgtctcagcctcccaaagtgccaggactacaggtatgagccaccgtactcagccttccttcattttttatttaaataaatcctgaacctacaccagcattggaaaaccatcaatcagttcaattttcttttttgttctattcagacattttaaaaactttaactctaatttacttaatgatattacaggtctaacaatgatctcaaacttaagaaaaattagaaattctttttagtcacatactgtataaaaattaaaaactgattcaaagagcaggcatatcataactaacaggaaagtccaaaaatttgatcacaggcataacttccaagttttacatgtccagctaagtcatttctctaattggaacactggacaaagaaatattcaaaagtatcttcttgagcctggcacagtggcttacacctggaatcccagcactttgggaggccaaggcacgtggatcattagaggtcaggaattcaagaccagcctggccaatatggtgaggcctgtctctactaaaaatacaaaaattagccaggtgcgcacctgtaatcccagctactcgggaggctgaggcaggagaatcgcttgaactcgggagatggaggctgcagtgatctgagattgcaccactgccctccagcctgggcaaaagagtgagactccatctcaaaaaaaaaaaaaaaaaaaaaaaaaggatcttctcaattttctctctaaataaagtggcatgatttcagaaaaaattctccaatgatattttctattcttttcaattaaaaaaaactacttcatggataacatcatggattcctaataacatattctagaattgtccatccttagagaaagaattccaccagtttctagtttttcttctttaaataaggttcaaatgaacaagacacagcataatttcccagtgtttttaggtaaaatcacaataataacccattgtaagatgcatgaattcatatataaaaaccttctattttgttttcttttgttagcacagacatctacttttgagtagatgaagaggagaataatagtagtagtaaataaagggtctactcctcattatattgaaaaactatgaatatttccagtgcccactagctgacagataaactgagaaatgagtgtgaattgtctccccagtcaacacccccaataccctttctatgtttaaactccatagaaatacgatgtgaatctgctttgtttattcaagccccacacccaacatactactggaaaacagcaggtgctcaataattttttttttcgctctcgcactcaagctggaatgcagtggcacgatgccagctcactgcaatctccacctcctaggttcaagcgattctcctgcctcagcctcctgaatagctgggattacaggcgtctgccaccatgcctggctaatttttgtaattttagtagagacggggtttcgccatgttagccaggctggtctggaatgcccgacctcaagtgatccacctgccccgacctcccaaagtgctgggattacaggcttgagcctgtaatatatatttttaaatgaacctggacaaatatatttttaaatgaacatattctacaggcaaagattaagctggacaccaaagctcttcatttatgaatatatctgtcaaataaattccccaatccattctcagtttctaacactagccaaggtaagactaaagaaggctaaaattaaaacctcattgtttcaatcaacaaatctttatggagcatttcctacatgctaaacagcgtgtctggtaacgcgaggtaaattacacatatgaagccctagtctcatgccaaccattagtctgcagtctagaggacagactggaaatggcaaaatatggaaaaataaagttgaaatatactaaagtttctttgttgactcatcatactccttagataaatctcactcagtctcacatctcagcaggtaaggttgttttcttttaaatacatgtacggtcaaagatttctgcatactatatcctagccacagaaatgtccaaaaaagtaataatcagagcaaattcttctccatatcatgaacctccaattatagtatgcaattctagccttcagaacacacacacacacgtatagatacatgactacatatacatatattcttatgcagaaataatcattcatttcttacacaataaaaacccaaaactgatctacaatccttgtagctctgaaattctctgtttctgactgtttaggtatttcataacaacttctgcttgaattttttcaagaatactcttgtttagccacctacctaattcagagttagcaaatggcctctgaatagactgaaatctctctttttaagcaccacaattaacatacatgatatatttcaggtacatcttcctgatttttgtttttttaacaagtctgtctcctaccatgcaataatctgacaagtttaaatatgtccagtttatcaaaatatatttacactgattgttcaattttgttcacaactatttcttagaggcaccaaaaattagccccattccaaaactgacttatggaaacacctatggtattgttttcagataaaatacaggatacaaacttaaatttggacgtcagataaacagtgtgtgtgtgtctagaattgaatatttctggtcattctgtacttttatttggtaaatatagcaatactaacctataggcccctacaacgacatcatttccaacaacagaaaaaattaattagtggtatttcttactgtgtcaaataagatcagcaagtaaatatacaatgacaaaattcagggtgaaactcagtcatattaaattaatagtttctcacatgacaattgtcttttagaaaacaccttaagtttctaaaaattctatgtgggcaaaaggcttttttacagtccctgagcaatgtaccactcagtaataaatgcaaaaggtactattgagactatatttcttcctgcatataaatattaggtattcagtttgtactttgagaaactgttgaggtttaccaggcaaaatgaaaaaaagtattaaactaaaagaacacattaatgacatctgccctgttggtgttcaaatagatgaattacctcacaggattgctggtcaaagacactcggagagactccaggcatgtgacaagtctctcatctgcagaccccattttcagctcatgaatgaattcctgaggtgagatctgtcggcttctcttaagacttccctataaaataagtcaaaaaatgttttgattaatactgcatggagattacccattaaaaaataacaagttaatctccctaacagcagcacataactactataattaacactatttgggcaagggtggtaaataatttccttacttctgcccaaaaatctatgaattcataatgtgtggtatccacaaaagatagtaatataacatcagaaggtgtgcaaattgaaataactgccttctcaaatgtaaaatgacatggagaacaattgtatactatagaaaatatcttaaaatacagtaatatttttaggcacacacaaaataaaattcaaaactcaatacaagaactaccctattaaaattagtattctgagcagtgtagaaaaggctattaggtattaattcattcaactatcactataagcctagttctaggcactgtagacacatggattaacaaaaagcgaagtctggaagaaatgcaagcaagaaaataataattttctttacagtctagttcctgtaacacagcaccaagagactcaaagaaagaacatctaacttggcagaacagatcagggaagcttgcaaaacagggctacatcttcctggtttttcttttgtaagtaagcattagggaggcaaagaatgagaaaggaattaacttccagaccaaaacataacacacacgtacacatgcagagaaaaacaaaaacatatgcaactgaagacagaggccagatcatggagtgatagagcactactatgcaattagctctcctggggagttttggaaggatcactccagtgtgaaatatgaattagaagagttagagttcactcattattcaacaaacattaagtacctactaaatactgggcactgttttaagtactgagaatagagcagagatgaaagaagaataagagattgaacttcctacctacatgtagctttactacatatggggagaaacaggcaatacataaaataacgaaaatgcattgcactgtaaataataaatgctgtagagaagaataaaagcaggaaagagaataagtagcttcatatgagacatgcaattttaaacaggatggtcaaagaaagcctcacagagaagacttcaaaggcctcaaacttgagtgtttaaataaaaagtctgaaggagataagacagctaaccatgcatatacaggaaaaaaaaatgctgtgatggagggaactgtaggttttacagtccactgaaagaacttggacttttactctgagatcagaagcagagagatctgttgagaaggtatctatatagcctagataggaaatgatgaggatggtgaactaacaataaagttctgaattatattatttgaattacagattcaccatccaacggcaggaaatgaattgtgtaagttcaaaagaagatcaggtgaagtggtacgaaattcggtgtttttcatgttttttgtttttattaatttactataatgttattcaaaacaacattcccaataaagcaaaacaaattagcactgtaaagacgggttatttttattcatgtcattatcaaagtagtaatttaataaagaagaattcaatggtacaatctccgaaaataaaaggggaaatggtgaaagctatgaaaatgaacatccgattatttttaccgcagtcactgatatcattcaaagaacatattcaacttgtaccaacagagcacttattgatgtctctttttgctctgaattaccaaaggactgattgttcaacagagaaaatttagaaaacacagaaaagcaacaggaacaaaggtgcctcaaaataactactgttaatatatttctacataaagcatttttctcatatatagagagaatattaatatatttgcatatatttatattttaaaacatatatgatatggtttggctgtgtccccacccaaatccatcttgaatagtagtttctataatcctatgttttgggagggatccagtaggaggtaactgaatcatgaggacggttacctccatgctgtcctcatgatagtcagtgagttctcacgagatctgatggttttaaaaggggcttttcccccaccttcgcttggcacttcttgcctgctgccatgtaagatgtgactttgctcttcctttgccttctgccatgattgtgaggcctccccagccatgtgaaactgtgagtacattaaacctttttatttataaattacccagtcttagctgggtgcagtggctcatgcctgtaatcccagcactttgggaggctgaggcgggcggatcacctgagggcgggagttcgagaccagcgtgaccaacatggagaaacccatctctactaaaagtacaaaattagctgagcatggtggcacatgcctataatcccagctattcaggaggctgaggcaggagaatcgcttgaacccgggaggtgaaggttgaggtgagcagagatcatgccattttactccagcctgggcaacaagattgaaactccgtctcaaaaaaaaaataaaaataaaaataaataaattacccagtctcaggtacatcttattagcagcgcgagaaaaaactaatacaatacactttacttatttaaaacatcgtttgatacctattgttctataggctattatctttaagcaatatttcatgaacatattccaattcaaaacataagccataaagaatatgacctcttcctgcctacagactattgcattacttacttaattagtccctggctcttgggcaagtaggttgtttacaatttcttgatatcataaatttttcaagtttcctgtgtgtgctgtcaggccaatatttttatccaaaaatacagcagtggaggttaactagatgatctcttgcagcccattctaaatttattaccgaaaaacttgcaatttgggtaggatcaaaataaaccacaactgaataaatagatttttttcttcaacaataagtaagctccatgtagcaaatactttttaagtatgagaataaccagtaagtgcatgtggataagaacaaaagtgatattaaaagataaaaaacaaaaaccacctatcctacatcttagccctgtctcacaaagacaataattcttaattcctttaacagtttcttctgatagttgcttaatatgtctaatgtacctgatatttttagatttctaaatattcattattacctttgatttgtattatgaaaaataaggatttaattatcttcaaacattggaacctcttctcttccaactcctgaatagcaataggtaaactcaattgaaccaaaagatgccattccatgaaatgagagctaactgaatccacattttataaagtccttacagctacatccctaaagagatgagttcaggcatccaaaaatcttaatgctttagttcattttattatcactgaataggatattatatgtcccaatcataaaatgctcaattactgtaaggatataaacagacacttttcaacggaagacatttatgtggccaaaagacatattaaaaaaagctcatcatcactggtcattagagaaatgcaaatcaaaaccaaaatgagataccatctcacgccagttacaatggcgatcattaaaaagtcaggaaacaacagatgctggagaggatgtgtagaaataggaacacttttacactgttggtgagagtgtaaatagttcaaccattgtggaagacagtatggtgattcctcagggatctagaactagaaataccatttgaccgagcaatcccattactaggtatacacccaaaggattataaatcatgctgctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaagaatgagttcatgtcctttgcagggacacagatgaagctggaaaccatcattctcagcaaactaacaacaagaacagaaaaccaaacaccacatgttctcactcataagttggagttgaacaacgagaacacatggacatagggaggggaacttcacataccggggcttttcggggggttggggggctaagagagggatagcattaggacaaatacctaatgtaaatgatgggttgataggtgcagcaaatcaccatggcacgtgtatacctatgtaacaaacttgcacgttctgcacttgtatcccagaaattaaagtattattttaaaaaaagaaaaaggaaatacctatagataaaactacaacacatttgtggaaactgaggacaacctacaaaaataaacgttataccatactcacagaacagaagaattaattttattaagaaatccattaagtacattttctgaaaaaaaaaatccatagatgcaatcaatgattaccgtcaaaatcccatcaagtgttttgtagaaattgaaaactacattctaaaatttatatgaaaataaaggagacctaaaataggaaaaacaattgtgataaagaacaaagttggggagcttacactatctgatttcaagattaactataaatctatagtaatcaaattagagtgatacaggcatcagtggaatagagagtccagaaatataacttatatcatcaatgattttcacgaaagttgtcaatatgattcaatggggggaagaagaatctcttcaacaaatggtgctagaacaattggactttcatatgaaagaaagtgaacctggatcctagacctaaaagtaaaagctaaaactataaaacatctagaagaaaacaggtaaaaatcctccttgccttggagaaggcaaagatttcttaaataggacacaaagagtactagctataaaactaaaatattgtacctcattaaattcaaaagtctcttattaaattagtttcagtaaggaaatgaaaggtaagcacaaaccaggagaaaatatttgcaatacagttaagaactgtatagtgtctgagatttcaactgtatagagtctgagatttcaacttacaagctaagttagcctgttactatttcacagatgctggcagaaaacacaagactcctggattagagccaaaggacttcattatgcatgtgttgggtccctaacccacccagtcgcacggggacaatgcagggcccatggtgaatgcctgcacatgcagtggattgcatcataagagaagaacacaaagcttgggggattcaccatttttatagtgagcagtaataggcatgctcattgtgcagagagaggcaaaacctcgcctctccaggctactcactgcaaatgcaactcagaaaaatgggatgggtaaagagcaatcaaaccttgcattcttggcatagccagcaagtagatgtagggaaactcaggacccatggaagactgcctctcccaatgatacatttcataaaggactagtattcagaataaagaactcctataactcaatagtaataagacaaattaataaacagattaaaaacttcataacagaagatatgtgaatggccaataatcacatgaggacatgttcaagatcacctgtcagcagaggaattcaaattggaacaacaaatgagggagtgctacacagtccctatagtagtctcctagagtagtgagaatttgatactcctggaactcttctacactactggtggcatataaaatgatactatcaccctggaagatgtttgtttcttttaagttaaatatacattgcccatattactcagcaattgcagttactagagtagtgagaatttgatactcctggaactcttctacactactggtggacatataaaatgatactatcaccctggaagatgtttgtttcttttaagttaaatatacattgcccatattactcagcaattgcagttactagagtagtgagaatttgatactcctggaactcttctacactactggtggacatataaaatgatactatcaccctggaagatgtttgtttcttttaagttaaatatacattgcccatattactcagcaattgcagttaagtgttaagcaggaggaaaaaaatgaaaaaaatctacgatgtatggaatacctttattcttaatagttaaaatctgagaacaacccaagtattcatcaacaaattatagtataaccacacaatgaaatactatgcagcaataaaaagaattcactactgataaatgcaacaagacaaaggaatcaaaaaattatgctaggttgaagtagcccaaacaaaaagtacacagtggatggttctatttatatgaaaaaccaaaactaacctgtcaatcttttctctaggaccattacaattcaggcacagaagcagagctattaaatttggtgtgtttggctggaggataggattaaaaggaggcaacattttaaatagggcagcaagtagatttaaccaataaacactgggaaagacagactaaatccactagctaacgataattacttcagccatattgaactgtccaacttgaacaatttgttgcctcaaggattctgcattcccacctgagaatcctgcctctgacaccctccgcccttatccaaaccctcaccaccactactacaacccttacccaggcctactcctaaacattggttagacctgggctgagagtggcttcccacaaaaggcctctcgtgagccacgcaatgggtcccttcccccagtctatggattcatttttcataactcttactctgtattaaaataactttcattactacttattatttaaaggatatattgaacacctattgtgtgccaagtactgtttacatgatgcagacacaggagtgacgtaaaagtcaaagatgagtcctaggacttcagtctatgccaaaacatggtaccatctacttagatgggggagatagaataaagagagtgagtgataggggaaatagctatttaagagcctctagagaaaataatatcttttgttctaagaaaataacgcttgtgcggctaagcatggtagctcatgcctgtaattccggcaacttgggaggctggggcaggaagattgctagaggccaggagtttgaaaacatactgggcaacacagtgagaccccatctctacaaaaaacatttttcttaattaacccagcatggtggtgcatgccagtagatctagatactcaggagactgaggttggaagatcacttgagcccaggagtttgaggttgccatgagccatgatcgtgccactgcactccagcctaggcaacagagcaaaactgtgtctcaaaaaaagaaaagacagaaggaaagaaaatatcacttgtgcagagaccagaatgaagaggagaggacatgggaaagctgagaaaaagaacttctagcaaacagaagagaaaatacaaagccttgtggcaggaatgaacttggcatatttagaggacagtaagaagactcagtgaacacgacaagagttacagatgacaaggacagacagaaaaggcagggctccgatcctctaggcaggcagctgaaaaactacagcctgagtgtcaaatgtttttgtatgatcttggggctgagaataattttcacattttcaaatgcttgttaaaaagaagaggaagagaatgaagaggaggaggaggaggaagaagtgaagaaatcagaagcagcagcagcagcagatgcaactgagaccatatgtgacaaagtctaaaatatttactgtgtggacatttaagaaaaagtatgccatcccctgataggatcttataaaccatggtaaggactttaggttttattctgagtgggatggataagtattggagagttctgagcatagaaagtataagatgaaataaacattttttaaggatttttctatctactgtgtggcaacagacagaaacaacgtgaaacaaggaggtcagttagaagactactgcattgtctggtcaagagttgttggtagcctggcataagatgcagtgatggaaaacattagatgtcctcaatatgaaaataaattttcaatgtacagcagacaggaggctggtagtttagatataagaatgaaaaaagtaaactgtgaagatgatgtccaggtttttgttctcagcaagtaaatgaatactgtctactgatcactgtgaccttgaaaagacccgttttagtggtggattagggataagcctgatcacaaattcaagaagaaaagcaagaagaatggacaactcttaggagattttctgtaaaggggaaaaaagaactggggcagtggctagagggaatcctggggtataatttggggggagtgggaaaaaaatatatatatatggtaatgtttgcatgctgatgagaatgaccaagaaaaggaaacaaaactgatgacgcagggaggtaggtacaggctcagaaaaacaaacaagcagccaaacaaggtggctcacgcctgtaatcccaacactttgggaggctaagacgggtggatcatctgaggtcaggagttcgagaccagcctggccaacatgtcaaaaccctgtctctattaaaaatacaaaaattagccaggcgtggtggcacatgcctgtaatccaagctacttgggaggctgaggcaggacaattgcttgaacctgggaagcagaggttgcagtaagctaagatcacaccattgcactccagcctgggcaacaagaaactccgtctcaaaaaaaaacaagaaaacaaaaaccacttgagtagatgacagaggatgtgccctactatacaaggggagagactgaccttatacagctgcaaggaaagtttatcactgtaaaaagagcaaaagcagagtttaagggaacagattctggtaccttgtcagatctgatgattagaaagtgaggtatggcagttctattctgattacatcaacattctcagtgaaaaaagcagccatataatcaactaaaagtgagaacaccgagctgaaggtaggaaattgttttcaggaagtaaagaattgcaataaaaatggtcatgtggtaggatatcggagcactgttaagggcttgcttattaactgtggtcattcaaaaaacactagtcagtgtagcagctacctgcttcctcccagatgcatgctgtgctgaggtgcagatgcagaggagggggcaatttagtttaaccaagggcagggtttatatgaacgatgaggcaaacaaactgatggtatgtgtgagagtgaagatctgagggtgttaagtatataaggagagaagtaagggcatggcaggaacagggaggtgaggaacatgaaacatgtaaagtcaatgggtcagaattgccaatgggattgcaaaattcttaaagtgagggcactaagtaaataggaaagatagacagtgcacaggaaaggaagtctgtaaatcatatttagaagtggtattttactgtcccaggtgactgagattgggtgaaaaaacaaagttcactaggagtgataaagtcaagtaaatgagaaagtgggatgttggacagatcacatatgtgaataatgaaatcattagggatgatggaggtggtagtagcataaggaaaagcaatcaactaggtagcccagtcttcaaggtataagaagtctgtcatacatgccagcatctctgtgtgatgccatcttctccactagaatacaccctacagggcagtgtctgcatctgcctaattcatcactgtaacaccaattctttgcaaagtgaatggctttcagtgaatgaatgaagttataataaaatggaaggtatacatagactaaggttaaaataagaaaagagcaaaggcgggcggatcacctgaggtcaggagttcaagaccagcctggccaacatagtgaaaccccgtctctactaaaaatacaaaaattagccaggtttggtaggatccatctgtagtcccagctacttgggaggctgaggcaggagaatcacttgaacccgggaggcagagattgtagtgagctgagatcgcgccactgcactccagcctggtgacagagccagactccctcttaaaaaaaaaaaaaaaaaaaaagaaataataataagaaagaagaaaagtcacacacacctcttaaattaaagaaataggaaatagaccagagagactatttttcaacacaattaactaccttttattatattactatccaaacacaggtatagaaaaaaaggaaattgagggggaaaatattatattacaagaataatcagaaatactccttttaagaacagctcttgtatttcattttacataacttcaaaggaagagggaagtacggggaggaaggaaaggatactcacggctgcatatctttaagtccattagccatgaagatgaaaatacttagaaagccttatcccctgtggtatcaaaacatattagtgagataaggatgtctgcctgacatcacaaaaattagaaggatatttatccaacataatttttaaatctttttaaatcctttagcaaattttattctaaaataccaaatgcagcatagaaagaaaagtacatagattcctcttatcatattctttattaaatgtattctaaggtacaaaaagtaatataccctttcccataccatttctgttcgtctaaaactaaatgctctttcttttgctaggtaactattacaggtaatagtaaccctcccctttgacctgtcttgaaaagattactttgcccctacctaaatgactacatttcatctcagttcaggtgtaacacttattcagtgtatgttcactcactattctatctcattgtttgctttattcaatgtataagaatacattgaatttctagttaccagttgatttttgaaataactgaatggtttttatacaaccataaagaatctaccatttattaatgaccagatttttaaaataataaatgtaaaaaaaaactaaatctgatatatctacacactctgaaagaagatgatacagcataatgccaatatcaatcaggacaatgaccttctttatctgcctaatgaagtatctaacatatggtagttgcttaaagcaaaagtttgcctagaatacctgtgatatcaaaggagtcagaaattatattcttaaacactactccaatcactgtagactgttttccaactcactaaatgataccttatttctcccagatagtagcctataccaaaattccccatgcaacatcttcaactgctggtgatagcttaatctttaaatcacacttaaacctgtagagaaaaccagtattttttttaacatgaaggcccataatatatagcctctagagattaaaatattaagatatcagagaactgtaagaatagtttgaactttaatttttaagtgaagttagttactagattctagatccttctccataacatttactttgtaattttaagcaagtaaattacagaaaacagaaaactgttatctacataaagcctaaatagtgaaaaagcttacgttctcatagtgataagagagttaaatgcactcttgcctgggtatatgtatctatctctatgcctgtaggtttctatttaagtcaataaccattaattaactgcctcagtttttctttgattttgcaattgctgaattcccagtacctactcaggtgatgagacttgtgaagaagaatgagatgatatgaaatgtcaagactatttaaagaaatagtttgcactggtagggacaatattttaagagcagagcagagtcagtgcagtacaaaacaagggtaagcacagttgctgccaagagggtaattataatctaaattactatcatgcatattactattaaaatgcattgcgactatttccttgcatttttcaaatgatttcaagcatctctaatgtcaatgatcaacagaaacactaagctgtcactgctgtatgaataactcattttcagaacatatacaaacagatctccagtgccaataaaatctgttattcacagataattttatgcaaacacatagtagaaactatgaaagctgaagaatattgcagaaaggtgcattcaccaacaaaataaagtttagcaagggattcccttaaagagttacttggctttttaaaaaaacatttaatgagtatcattacgtgccaaaaactctgcctataatttggaagctggttttagagtacattaaaaagcttaaaattaccaactatattttacccaaaaaaaagataaagtacagaaaatatgctacttccccccttttcacttctaaaatatctctataaagaacaattatagtgatctaatactaattttagacaattagaaattaacttgacatagcagaagaaatttgacacacaacattctcttattatccatcaatatttaaccagcacgacctccaatctaatggaaaagctgtcctgcattggcccagtgccttcaataagagagttgattatttagactattttacatatttaagaagtgttgcttcaactgctgaatgcaatactccagtgttataacacttctacctgcttaccatgaccagaactgaagtattcttttagctcttaagcctcaaaaaggatatactatacagataacagtctaatgtttctcccatagccagagaatactaaacaaaccatgatggaccacataatggagtagcatgcaattataagaaaaaaagacaatatctctatgagctgataaaatcatatcctagaaagcatgtgtaactagaaaacatgccaaagaatatctacagtatattaccttatgtttatgaaagaaagaaatgaaaaaatacacatatctcttcatttgtgcaaaaagacacaggaaggaataaggaactaatacaatcgcataccttcggggtggatgggaatatggtagaaaagatgaggagagaaaatttccagagaagaaagggggatgagagactaagtgacaattttttgcatagttattttttgtaaagttctgacttttttagtatagtcctccttgtatagttctgacttttggaaatatgttaatgtttcatacacttgaaatgagaaatattaatatcagaaagagtggaaggaaatcctaaaaatccaaacacaagaaacctaattgtatttcaaatgaacaataatgtcagagaaataagagtatgaaaatatggaaggctagaatgaaccctgtaatgttagactctaactaaagattatcaacatgaacttgaggtttttgaatatatataaaatacatatattatctattatctattttatatgttatatataatctgctataatatattatctagctatatatatagaaaagagagagaggagagagaacgagcaatagagacagagaaaggagagttggagggatacagatacatagacatagatagatgaaaagaagaataaagatgggtatgtgtatacaaatatgtgttttctatacatggatctacatgtatttcatatacacacatactcatgtacatatacacatatcacatacatgtaaatatacacccatatgtacttgtgtatttttattttattttatttttcctagctctgtctataagggcctagaagatataccattaaaagacctagcatccagatcttgaattctaaataacattctccactaaaaggaactacaaggaacttggggtccttggagaaatgtctgactccaaggctgggtgtagaatagtaccagatgatcctggaagacagtgtacaagacaataggaagtattcaaagaatgatagggacaaaaaaggacaaaggaactagcttgaagagacttctattggccaaatctatctgggggagtgggaagagatagggagttactacttaaaccatatgaagtttccttttgggttgacaacaatgtgctggaactagatggtagtgctagttgcataacactgtaaagatattaaatgccactgaattgtgcaatttaaaatgataaattttatattatataaattttgcccaattaaaacaagtttttcattcctcctaagaacttgaacaaggcaaggatgctcactttcaccacttccattcaacaccgtactggaagtcctagccagagcaatcaggcaagagaaagaaataaagggcattaagaggaagtcaaactatctccgtttgttgatgatgtgatcttatagctagaaaaccctaaagacttctccaaaagactcctagatctaatcaatgaattcagtaaagcctcaggttacaaaatcaatgtacacaaatcagtagtactgctaaatgccaacaacaaccaagctgagaatcaaatcaagaactcaatcccttttaaaacagctacaaaaaaataaaataccaaggaatatacttaaccaaggagatgaaagatctctacagggagaacaagaaaacactgcttaaagaaatcacagatgacacaaatggaaataacatctcatgttccagaattggaagaatcaatatcatgaaaatgaccatactacctaaagcaatctacagattcaatgcaattcctatcgagataacaatcccattcttcacagaattagaaaaagcattcctaaaatttatatggaaccaaaaaagagcctgaatacccaaagcaatactgagcaaaaacaacaaatctgcaggcatcacgttatctgacttccaattatacgacagggatatagtaaccaaaacagcatggtattggtataaaaggagatacacagaccaagggaacagcatagagaacgcaggaataaagccaaatacttacaaccactgatcatcaacaaagcatacaaaaacataaattggagaaaggacaccttattcaataaatagtgctgagaaaatttgatagccacatgtagaagaataaaactggatccctatcactcacaatatataaaaattaacttaaaatagactaaagaattaatctaagacctgaaatcattaaaattctaaatgaaaacctaggaaaaactcttctggacattggccctggcaaataatttatgagtgagaccccaaaagcaaatgcaacaaaaaacaaaaaataaatggaacctaattaaacttaaaagcttctgcataacaaaagaaatcatcagtgtaaacagacaacctacaaaatgggagaaaatatatgcaaattatgcatctgacaaagaattaatatccagaatctaaaagtaactcaaatcagcaaaaaaaaaaaccagataattcctttaaaaagtgggcaaatgacatgaatagacatttctgacacttctcaaaagaagatataaatggacaaaaaaaatgaaaaattgctcatcaccaatcatcatggaaatgcaaattaaaaccataatgagatactgcattactcagctagaatgatcgttattaaaaagccaaaaaataacagatgttggcatggatgtggtgaaaagggaacatttatacactgctggtggggatttaaattagtacaaccttcatggaaaacagtagggagatttctcaaagaactaaaagcagatgtaccattcgatccagcagttccacaaatcactttatcagaaagacacctggacacgtatgtttatcacagcacaatctgcaattgcaaagacatggaatcaacctaactgcccaccaactggtgagtggataaagaaaatgtggtgtgttggtgtgtacacatgtgtatgtatatatatacacacatacacatacactgtaatactacttggctataaaaaaagaacaaaatcatatcttgcagcaacttggatggatctggaggccatgattctatgtaagtaactcaggaattgaaaatcaaatattgcatgttctcatttataagttggagctatgctatgtgtacacaaggcatacagcgtggtataataaatactggaggatgaaaaattaccttttgggtacaatgtacactacccaagtgacaagtgcatcaaatcccagacttcaccactatccaattcatacatgtaaccaaaaaccacttgtacccctaaagctgttgaaataaaattaaaattaaaaatattaattagattaaaaactgttaatatgtataaaaagtatgacttacatgttctatatatgtattagatgtccagtaaaaattttttaatggttaaaaaactaaaaaatacaatgttttaaaaaaatttataaaatagaaaaaaaaaactaatttgtagtgttagaagccaggagagaagcagtcttgaagaggagaaagggtagtgactgaaacatttgagtttatgggcattattctatttccacagctagatactgattacatgggtgtgtctactcattgataatttatcaagtggtatccttaagatttatggattttactgtatgaacgtaatcttaaaagtactaaacaactatttttaaatttacaaatgtttcatgctttatgctatttataaggtacattcaaatcaaattcttctgaaatccttaattcaggtttttaaacataccacttaaaatactttacatagattatcattatatgcttcctttctgaacaataaaattaaataaaaaggtcatatggtgtcacacaggaccacttgtttttattttggatcttcagtatacctctagtattggaaaatgtttactctcacctaaaaaacaaattgtgatttaaagatttaaaggcagctcaaagttggggggtgggggagctgattaaacaaacatggatgttctaatttgccagcctctatttgatggttcattgaaggatgaagatgtgttcagcacatctgaacggatagaaaaaatccactgatattcttagtcattggttcattatcgtctttactgtgttgattatgtttatgtaaaaagaaaagccacaacaaaacttcattgggcatttaccaacaaaaggggaggagggacaagaaaacaccagctgttccagtctttaaaattaggcaatttgttttccaatccctccaggtaatcgcacaattatttgcctccacagttcagagtactactttcaagtgtcactgttacatttacactttaagtctgtcttccttttttttcttttcttgatttttggaagaacaccaccttgcctcttcatatgtacaagctagcctataaatgtaatctgtttatattagtaaaaagctcaaaaacataaacagaacaaaatctaattcactttctagattattcttcatattaataatagtaccagctaaatacaggcaaaaaataaatagtagagaggataaaacaaaatctttggatcattggatcacaccccactacaatccattatgggagtttggtctccgatttcctcagtataaaatgctcacagtggttatggagtggaagaagctgcaaaattgaaatatactgggaaaatgcctgcattgttgtcacaataagcaaatattctcttttatgattaacagtttttaaagctgtgcagtttatagagtaaagcaaaagaagaaagtactcacccatagtttgcagggtagggtaagggaacaacttgatcaaatgaatagatcaaaatgagaagcaactaaagtccaaccaaaagagttgtgttgttcatttgcttatacttcatcctctttgtaactaactggatagattgtctcatacgccttttatatttcccagaatcctgggcactattatgttctaaacagaaaatgtataaatacttcttaaataaaagagagggtaaaaaggataatagacctaaatttactcaactaccatgctcctaagaaaattcacaaacatgaaaatttaaaattttaataatatacaaaattatatctagtgattttataaattcataatttctaggatgttctgtaaaaacccagctatccacctaaaagatacattcaaataaccatgtaagtatctattatatactgttataataaccactgaaactcagaaataagaaaattctgcccatgaggtgctcatcattagctgagtaagaacatctaaacagttaaaaagtaagggatcctgtatatgaacctagtctctgggagcagaagggaagatgtcccaattgttgcctagaaggtcaggaaagcttcccagcagagatcctacaagaaccaggtcttaaaagaccaggattggaaagcagaataacaaaagcactatgggccacggcagagtcaggtggaagagctggtgtgttttaggagctagatgtccacatttacaggttttataggaagggagagaatagaagcacaaaacacacagaaacaagaaagtgaaatgtgcctacctcatactaaggaaaggagaccttaacccatggacaataggatggaactgcaaaactgattggaaatgaagttacaaaaagctgtatgttagaaatacattcaagcaacagtgaggaagactgagacatgagcctctccagaggcttagaaggttacagagacaaagaggcacgttcaggtggacatgaataaatacatcttctcagttctaccataacatttaaaaaaaaaaaaatcaagaaagaaacagctggaaaaaattgctacatttgatcacaaaacatgcccctccccccacacacacctcccacccccacatgtaagaaggaaactaaacacatctgacttcaaggaacttaaaagacaaaatacagggagaattgtttttcctcttaatagacgctaagcaaaggagcgtctctcaaacaatctaactcttctcaaaaatattcaattttctactatctaaaaaaagtaaaaattttccaaaacctacctttccaacctcatatcccactattctctttcgtaagagccttaactccggggggtgagggggagaacaactttccaatccagctatgcacaccatggttttccctatacaaacatctttactgcctacagcctcctacacaaccccacctccaaatgttcaaatcctatctgctccttcccaacaaaacctcttctaaccccctcggcaggagatagtgctgaccctcaaattcccaccttaggtttatttcccctattttatcttaattacttctaccttgtttcagtgacatatttagacattttatgactacaagattaaagactccttgagagaaagataaatgttgggtttatctttacctgcatctcagaaaacaggaactcaaaaaacattttaaaaaatttttgtaatccttgattaaaaccatattggggctactggttaaaacaagatacttacatccatttatccattctacatttgctggacatctattatatacaagcagtgttttacatgttaaaaatacaaaaatgaacaaaacctgcaaaattcctgttgagctctggaaatacatgcttgggaattttaccaatttactgggtaattctttccagagtagtttttttacgattactacttaaaccagtgtttctgtatactatttccttccaattacctttaaacctttacattctgacatctaccaagcacaacccctcatgaacatcatgaatgaataaggatatctgtgccagtagaaaaggtgaacatgtcagattcttaagttctgtggtactgtgaaggaacttgaacaaaaatacaggcatacctcagagatattgcaggatcagttacagaccatgataataaagcagatagatattacaaaaagtgagtcacgtgaactttttggtttcccagtacacagaaaagttatgtttacactatattgcagtctatcaagtgagcaacagcattaggtcttaaaacaacatacataattttaaaatattttgctgcctaaaaatggtaacgatcatctgagccttcagcaagtcctatttttgctggtgaagggtcttgccctcaatgttgatggcagctgagtgatcagcgtggttgttgctgatgattaaggtagctgtggcaatttcttaaaatcagacaacaatgaagtctactgcatcaattgactcttcctttcatgaaagatttttctgtagcatgcaatgctacttgatagcattttactttcaaacttctttcaaaattggagtcaatcatcacaaatgctactttatcaactaagcttatggaagattctgaatcatttattgtcatttgaacaatgtttataacatcttcaccagaagtagtttccgtttcaataaaccattttctttgcccatccataagaagtaactcctcatttgttgagctttatcataacattgcagaaattgtcacatcttcaggctccacctctaattctagatctcttgctgtttacaccacatctgcagttattcctccactaaagtgttgaacccctcaaagtcatcaatgagggttgaagtcaacttcttcaaaactcatgttaatgttcatagatagacctccccccatgaatcacaaatgttcttgatggcatctagaatggtgaatcctatccagaaggttttccatgagaggagtcactatctatggcagctccagccttgagaaatgtatttctttcttaagacttgaaagttgaaatgactccttgatccatgggatgcagaatggatgttgtgttcacatgcataaaaacattactctcctggccaggcacagtggctaacgcctgtaatcacagcactttgggaggccgagacaagtggatcacctgaggtcaggagttcgagaccagcctggccaacaaggtgaaaccctgtctctactaaaaaatacacaaaattagccaggcatggtggcacgcacctgtgatcccagctactcgagaggctgaggcaggataatcacttgaacccaggaggcggaggttgcagtgagccaagatcgcaccattgcactccagcctgagcaataagagcaaacccccaactcaaaaaaaaaagacattactctccttatacctcttcatcagaactcttggatgactaaatgcactgtcaatgaacagaaatatttttttaaagaatattttttctgaatagtaggtctcaacaagcgggcttaaaatgttcagtaaaccatgctataaacagatgcactgccatccagcatttgttgttccatttctggagtgcaggcagagaagatttagcatcattcctaagggccctaggatttttggaatggtaattgagcattggtttcaactttaagttatcagctgcattagccccaacaaaggagtcagcctgtcttttgaagcattaaagaaagacattgacttatctgtagctgtgaaactcctagatggcatctttttcaaatataaggctttttcatctatattgaaaatctgttgtttagtgtagccaccctcatcaatgatcttagttacaccttctggataacttgctgcagctgctacatcagcatttgctgcttgtgtcaccttgcacttttatactatgaaggtagtttctttccttaaatctcatgaaccaacctctgctaggttccaacttttcttctgcagcttcctcacctctctcagccttcataaaactgaagagagttagggccttgctctggaataggctctggattaagagaatgttgtagctagtttgatcttccatctgaaccactcaaaactttctctatgtcaacaataagattgttttgctttcttatcattcacatgttcactggagtagcacttttaattccctttagaatttttcctttgcattcacaacttggctgtttggcataagaggcttttggcctatctcagcgagttgacacaccttcctcactaagcttaatcatttttagcttttgatttaaaatgagagacttgggattcttcctttcactgaacacttagaagtcattgtagggttattaacttccttaattttaacattgctgtgcttcagggaatagggaggcccaaggagaggaagagaaacagaaaagagctggtcaatggagcagtcacaacacttattaacttcactttctaacatgggtgtggtttgtggcaccttaaaacaattacaaaagtaacatcaaagatcactgatcacagatcagcataacagatatacaaacaaataatggaaaagtttgaaatattgcaagaactaccaaataccaaaatgtgacacagaaatatgaagtaaacacatgctgttggaaaaatggcatcaataggtttgctcaatgcagggtttccacagtcctttaatttattaaaaaaaaaaaaaaaaaaaaaagcagcatctgcaaagaccaataaagcaaggcataataaaacaaggtacacctatattaataatagtaaaactacaactattataatacaactattataatttcttctgttcccaaatctgatcttatgttgcacttactgattgtttgactcccctaataaaatgtaagctacattagggtagggacatgatcaactttgctcatcatagtattcctactgcctagtaacagtgcctgaaacacagcaatatttgtcaaaagaaaaatgaatgaacaagggagagagagatgaaacaattccactaatttaagagatacactgctgttacagtatctcaaactaaagttcatgacttggagacatgacccatgtcaactcatcaacaaatttccatttctggagttgatctttaaaaaattttcccaagttcccagaatagtttataaatatgctatcttccaggccaactactaaaataactactaacaggagagaaaagcacaccaatcacagctttgagcaacaaaaaactggtgggggtgggtaggtaattaagtatgtttctaattttgaatggaaaatcaaggagaaaatacagtggccctgaaaagccattatttaatcattgttttggatgatatatttcagaatgattaatattcatgatgatctgcagaaacctacacatttcctacaaatcatatatatcaaaataaaatgtcatttttaataaatcatttcttcagaaacaagacaagaaaattcaagaaaatagtataactttcatagaagtataatttttaagtgtcatttgcactcaataacatgaatcataagcaataagccattcattaaacatgaaagtaaattggtttatccttgaaatactaccaccctcaaatctagtagtggaagtgcagtaattcacacttgcattaatggattaatttttttaataataatcaatacaacaataaaatttttaagtgagaaaaatatcctatatattataaatgttatatctaatttctgatgaaacaattacatcacaaattacagaatgtaacactcaccttcatgaattaatttgtatagtcaccatatcacaggtcatgattcatacttaaatacagtggtgttgctggtaaatgtttaacaaccatttctcagtaacgcaaaaacagtctaatattgtttgccaatctatgtgatgtaaatactcccagatggctgattacaagcaaccagtgcaatgtcactgaatgcaaaggagaaagtgaatctagaccaccactgaaggatatattgtgctagactaatttgtgtttgagatatactgtagttataaatcacttttattcatcaataacttattgttcatatgctacattccaggctgagattaaaaattacataatccctgccctcaatgaaattagaattcttgtgaaaatcagaaatggcacatgccatatgaattttaaactgcttaaaaatctaaaacagatatttattttttccatcttaaattggcaacagcttacattcattttagattgctcaatcatcaatctgatttcatacatatctcaatatcatcaagttaaccaaaatgtatcaaagtgacactgaattacagatctttcctaaaaggaactatatgtttatggaagtatataattggtattcgaaattatatttttcaaaaattattttcttgcctgggtgaggtggctcacgcctataatcccagcactttgggaggctgagaccagaggattgcttgactccaggagttcaagaccagcctgggcaacaaaatgagacccccatctctacaaaaaataaaaatgaaacattaggcaggcatggtggcatatgcctgtagtcccagctactctggaggctaaggtgaaaggattgcttgagcatgaggaattgaggctgcagtaagccatgatcacgccactgcactccagcctgagcgacagtgtgagaccctatatcaaaaaaaaaaaagaaagaaaattattttctcactgaaagtcactctatttacatcttccaatgcatttactcaaccaacatttattaagtcaaatatatacaggcctggtatatatacatattggataaataggcataaacatatctctttatccaaccaacatctattaaatgccagatacagccatggatatatacagatagccgaccccttgctaggatgaggagatacaattagacttagatatgccattacctcaagctaatttccttcacagtaagtctatctgccatcttcaaactatgcctggagatttattttaatgtttctccacttctttagtttgaaaagtggactgtaaatatggcattctgaaatcctttagtcataattcctgagagtaaccaaatctatattacccttttaatatggttttctaaacaattttttaactcttctttaatttgattgtgtatatttatctgatttttttcataaatccatagcaacacacttttttgcctagcttttctatctccttcccgtaataaagtaatccatgtaaaaagcctggtatatatacgcttctgtattttaatccctacagataaaatcctatataggtgtgtgcatgcacccacacacatatacacatagagaataattccattatttcttaatagaatcatcttatatgattttctgcagatttgcttttctcattgttcacctcatggaaattcctcaagttatctggtattattcaaattcattctttttaatatgggcatattgcttcataacatgaatagtcttaattcacttcaccatctccttttgtttccaattgtttaacagcagtgaataaaactgtagaaaacacatctttgtgcatatgtgctcatctattggtgctttcatttctacaccatagagttccaggagtggattcttgggtcaatgagaatgcatattttcttttttcatagacatttcagataacttaaccaaaaatgctatattacatcacagttccaccagccatgtatgaaggtattttttctccactagaaaagtaaagatactggtaggtataaagttactttaatttggatatccatactgtcagtctttacagatgtacttacttatttgaatttgttcttccattgacttttcagatccttagcccatttttctttgtctttttttttattccaacatttattttaggttcaagggatacatgtgcaggtttgttacttggataaactgcatatcatggggtttgatgtacagattattttgccacccaggcaatgagcatactacctgatagtctttcaatcctcaccctcctcccaccctccaccctcaagtaggctccagtgtctattgttcccttcttcatgtccatgtgtattcaatgtttagcttctgcttataaatgcagtatttagttttctgttcctgcatcactttgcttaggataatggcctctggttccatccacgttgctgcaaagatcatgatttcattcttttttatgcctgtgtagtattccatggtgtatacgtaccacatttgctttatgcagttcactgtggatgggtatttaggttaattccatgtctttgatattgtgaaaagtgctgcaatgaacatgtgcgtgcatgtgtctttatgggagatttatattcctttgggtatatactcagtaatgggattgctggactgaatggtggttgtttttaggtctttaaggaaacaccatactgttttcaacaatggttgaactaattcacactctaaccaacagtgtataagcattcatttttcttcacaacctcgccagcaccagttattttttgactttttaataacagccattccgactggtgtgagatggtatctcattgtggtttagctttgtatttctctaatgattagtgatattgagcacttttcatatgcttgttgattatttgtatgccttcttttgaaaagggtctgctcgtgtcctttgcccattttttaatggggttgttttttgcttgttgattcaagttccttatagattctggatatcagacctttgttggatgcatagtttgcaaatattttctctcattctgtaggttgtctgtttactctcttgatggtttcttttgctgtgagggtgctctttagtttaagtaggtcccaaatgtcaatttttggttttgttgcaattgcttttggagtctccatcgtaaaatatttgccaggtcctatgtccaaaatagtgtttcctaggttttcttctaagggtttttgtagttttaggttttacatttaagtctttaaccatcttgagttgatttttgtatatggtgtaaggaaggggtcagtttcaatcttctgcatatggctagccagtcatcccagcaccattaattaaatagggagtcctttccctacggctcgttattgtcaactttgtcaaagatcagatggttacaggtgtatggctttatttctcatttctctaacttgttccattggtctatatgtctgtttttgtacaaataccatgctgttttggttactgtagccttgtagtatagtttgaagtcgggtagtgaaatgcctctggctttgttctttttgcttaggattgtcttggctattcaagctcttttttggctcacagaatttatagaatacatttttttttctaattctgtgaaaaatattcttggtagcttgataggaatagcactgaatcttcaaattgctttgggcagtatggccattttaacaatattgattcttcctattcacgagcatgggatatgtttccatttgtttgtgttgtctctaatttatctcagcaatgttttgtaattttctttgtagagtttgttcatgtctcagttagctgcattcctaagtattttattccttttgtggctactgtaaatgggattgcattcttgatttggcttttctgttggattttttttttttttttgctctttttttctagccaagtcctaaaagcccactgcagggtattgctagcagctctttgtaaaaatcattagaaatatttcttaccagatctattatttgtcttttgcctgtgcttaatttgacataaaaacagttttagggtttaaaaaaaaaagttgatcatgtctatgttttattttagtttcaagttttcagtttttggagaaaactgttctgcagtctgcaaaaaggacatcaacatccagaaagaggccaagggaagaagggagaaaatgccctggcatcggacttcattctggtgtcattccaaccttaccccttcccttccagatattcaagccaataaaatttccctttttgctcaaattatctcaagttaggcttctgtcactgacaacaaaaagaaatctgactaacactgccatatacttacccaactgaattgttgagtttgatacactgcggctttatgtcagtactagaaaattggtattatataaattattttccattttcactacccatgtcagtattcctaagtctccacatgtttatacaaagaacatatcattacatggtttattttgagagaaatggaattgaattatttcttcatgtacaatagctaaagcttttgaaattgatgtataattgacattattatttaaattattcctaagaaccacagtaataatacatttagaatttccatttgacaaatgtttctttttcttaaacatgcaaaatttttattctcacttccactcacccaaaagttatggatacaatggctaatacttaatttcagaaaatacttcccattttacgtgtttattctctagccttaaccttaacctcagagtcattattgtgttatttacagattgagattgttctgacctatttgtagccaaggagaagttgaccccaaagtttccatttctcttttatcatcttccttttctgattgctgtactcctctcccatcaggacagacaatagcagtctgcattgcattcctcagagttctaggattcagaactgactgtaagagagttgaccgtggcttctaagtcccactatcctttttcaaacagaatagcttcatatttatccttcagatatagtggggagggaggactgtgtaagactccatttttacagaaaggtttcctgcactaaacagaatttaagaaccattattctgcattattatttgtttatattttccaatctcaaatgggccctcaaggtagctttcagatatttttatcatatcccatttccttcaatgcttcttccaaacctatgagcccttctcaaaactatcctgaaatctgctccactctgaacacataactttgccccttacttcactgagaatagtgaagctacatagtatgaactggttcaaacttcttctttgtcaaggaaacaagttttcttctatctatacttgatccctctgcccagagaaatatgtgtgattccttatttttaaaacttttaaccctaaatctaatctaatcaatctaatctaatcaatctaatcccaatacctatttgcctcttttatcttcaatctctttctccctagtgactccttttctacaaacctttcaaccactcaccctctcacccaaacctcccccaattctgcttcccatcaggctactaattcatccctcactgctaatcaccaaacatctgagcagtgtggggcacattcgccaacccccttcctcactagacactcaattcagaaggctccatagatttggttaccttccacatgggccctctcccacggtagctcttacaaatgaccatcaggaacctcataatctacaagtctcttctcgatgcgcatctgccaatctcctgaagcaagatactttgtgttttcctacctgaactgccctcttcctagactatctcatctaattcttctctacctctctccactgtacctatagatgtagatatgcttgtagcagctggtcgttgtcctttcatgagtttctcctcctctacccacttaacagacattttcactatcactccatcttttctctcttcttgctaagttaacttcattgataagctttcatacatgcctttacacacatgcacaagaaaaccaatctatagcaggccataactaattttattaatttcaggggaaaatgtgtattccttgctcttctctatcagacttaaactttcatatatatgaacattaaaattttccttgaaatggaaaattggatagtaccaagaaacactagattacaaatgtatctttatcaaaatatacctcatactgcttactataagttatagttactaaaggtctctaacaaatctcagaataaaaagttgaaacacaatccagacattattgaaaaaaaggagaaataatatcagaaataaggctgacacttaaaagataactaaagaatgcacctatgtttagtactgctagatgctttaacaaatatatctgccagcctacacacataaagtaatattcatttattcttcacaacaaccatttgaggttggtgtcttcaatctcattttcaaggactaaaaataaagtaaccaaaaatattaacaatagttacctctgggggagaaattatggatggcttgcattttgttttgtgtattttctacaatgataatatattacttttgaaaagttgtgttatgatgaaaatataggccgggcacagtggctcacacctgtaatcccaacgctttgggagggtgaggcaggcagatcacctgaagtcaggagttcaagaccaggctggtagacatggcaaaaccccatctctactataaatacaaaaattagccgggcgtggtggcaggtgcctgtaatctcagctactcaggaggccgaggcagaagaatcacttgaacccagcaggtggaggttgcagtgagccgaggcggcgccactgcactccagcctgggcaacagagcgggatgttgtctcaaaaaaaaaaaaaagatgaaaataccaagttttcaactgaatccttttggaagcaagaattataactgggtggcatttcctagtaaatgaaggaatgaaagaactttgcaaaatggaaagtaacttagatgttatcaaatctagtcctctaattttttagattaaaagcaatccgtttatgtaacattaaataaactctcagatggacaatacataaattcttcaaatataaaatcatacttttcatatattttaatgtagtaacatacctcctttatgaggtaaatatcccagctgcctctatttttcatttatggtgatatttatggcatccagcattgtaacacataggtaaatgcttaataaacactatttgacaatgatcacaaactgaacacttaaattattcacagatttacccagatgtttccaagactttaagttctgtaaataaaagttactaaatgagtgccaatttactacaagaatataaaatgaatttttgtgctattccaagtcacatttaaaagctttgcaaacagcatgctattagctctgctgatttgtttttatttttcctaattgaaatgtggtccatgttatcaggccatctgcactgtggcaaaatgacctggtaaacaagacaaaaatggtgttctctgttaggaacaatatcagattctgtttctgctaagaaaacattattctaaagggatattttctggtactaatgctgaaaactttgataaaggaggccacagtaggagatgcttgttgcagtgcttaggttgcctgctaagatgctgacgacaatccagggtctctcccattaactccaataagtcagagtactgcattttcaacactgtcctggcaataattcagcactttagcacatacttagggcccatatatcacattgtactcctcttacctgcttatacattttgtctctactaaactgtgagctctctgaagtgctatagaccttatcttattcacattaactaccccaagtttcttgcatttaacagaagaaagactggattattttaggctaaaatcaaggagcagtcatttatgcaatggtttacatctcaccactccagaagattgacgtgatccgagggatggctgcccttcctattcctctagctctttataccacattatcctttgtgtgtgtgtgtcaaaaaatactatcctgagatatgcaaaaataccacaataaaaagtcacccataatctcactactcttttttaagtacacaaggaaatgaaagttcttgccccagtttctccagccctagtgcaagataatcactgcaaatgcttttacaagtttggttagaatccatcaagggttttcctttacatgggcagatatgcacagacacccactcattcacagtataaactcacaatgtctttaaacaaaaattggttcatactatacatatgcttttttttttaaatattgggtaactttctaagtcagatctaagtcattggttttaacagctgtattatccatcaactgcatgactgtactataaattacttaatcatgtctctattgataaatattttggttttaaatttcctgacatttcacacagtgctgcaagaacatgctggtacacagatctttatatgttcaagctattcttataaaataggttcaaaatagtggaaccattacatcagtagggtatacaagtttttattttgatagatactgacaaattatactagcaatagtttgcattgatatatatttctatactctcaccaaacatttactgtcaaaaatctttagtttttctattatgacagacaaaaaatgctctccatacctattttaatttacatattgaaattgaacgtcttttcatgtggatgtatgacattcattatttttcttgggcaaattgcctattgacatgaaataaacttcttcctattgggttgttcatctttttcttaatgatttgtaggtgttctttacacattattgatacatagcaaacgttttcttccagctttttatttcttctaactttgcttgctccctctctctctctccttcgctacccatacaaaagtttttagttgtattagcaaatgtagccatcttttttcccttatgacttctggattttaacctgctcaatagcactctctcacttgaagattaattttggtaatatcatctcaggatgatagtgtaattttcagataacttatctagcctcataaagtaagtttttctttctcaagagacagaaaatattaaaacctcagtcttaattatgttaaagtttctcccctttctcagtgtgaacctcactcaaagaaatctatagtgatgaacggggctgcagatcttcaccattttcccaccttgtacttccattccaccatgccaacttttcaggtttcctccattaccttcagggctggagacagtggggaggaaagagaaacagatgcagaaaactgctataatcaagcatcactgttatactctggtgccacggtcctccagatgtagctgatatccaagtgttgaccgtatcttccatggaatgcatatgtgcattactcagacagtaaagaaatactactaaagaaatagcagtccaccctgcataaactgtccctattgggggtcactgcacatgcagggggtccccttgggacaaaattcctcctaagacaagtcacagtcaatgccttctgaaagatccacatctgaccaatgttttggcacaagtccagcttgttccaaccataagtctaatcctttttctttgctctgccaccaaagcagctcgaatagcctcttgcctttagaacctagcagagtgaacacagtaagtttccaatctgggtctccaaactggaagggatacacatcaacctctgagtgcttctctcaaatgcccactcatttggctccagtccctcacaaggggtcagaaataatatcacagcattccgacacctctctctccgaagaaaccccctctgtcgatcttccatttcttaaattactgtgaaccttatcttgtatagtttcaaagtagatgacaggctaatggtagcacaataggctctgcagtctcttttcatggctgtgttgtttcagcacctgatatcctcagcccctgggcttctgtcaaaacgttgacataacaggaaagtcatatttaatttttctgttatagaaatcttagttttactgttattaaattcctatataggctgttcaaaaatcaaaacaaccttaatattagagataaatgcctcatctttggtaggatttttatttctttcctcataatgtcttatactttctaaattttctgcaacaatgaatcacttctgaaagaagaaaaaaagactgttaaaactgttgtattttaaatacctttatttggcacattacccactggtcacaatcttaacttggattttgccactaatcttaaataagcattatacaaaagtaattatttaaagacattttattcactcatttatcttgttacttatttattgggcattaaaatgatatctgaattctgatcatatatcagaagtattacttctatagcactgttaatgtgagaagtatatataaatcatacacctttttcacataagtagacaaaacaaagcaataaaatagtaacaaattatttcacactaaagactgcttcattaagagatactctattcttttaagttgtatctttgattttaataattttaaatttgagtatatgaataaatgaatgatacttggaatgttacttgattactaaacaagttatcttagaatttctaatcattttattttgattactgaaacaacctttgtgtcctaaaaaaaaaatcctcaaaaatgacagggggaaatgcgtaaagatcacgagctataaaatctaaatagtgcaaaaataaaatgagaacactagttctcatctaacttctctaaaacataaccagacaagaagtatactttaggagagatacattttgccaactataagatattcccaaatcttaaattataattaacttcagattaaattaaggaaaatcaaaatatgagataatatgagcctcccagtaaaatgacccaggagattacacgcacacacagttgcaccaatatcagaataaaattaatttatgacctcaaaataaaacaaatttattttagttgccataagaaagtatgactttatcaatttcagagtactctaagagaagtgaatatgtgttacaggaggaggcagtctgcatggtacctgcaaacatgtccagagacctaaagtgctgcaaaataccactgcaactccccaggaaagggagtattcagacacataaacacaattatctagtttttgctgcagcaagatttctctgccttcgtggagcttctagtttatcacattaaagaaagcacatgatgctgggtgcacgcacagtggcaggatcttagtctaaatatacgccccattatctccacagtggatcatccaacaaaccaagtaagcaactctctatcatttggcttcctgtgtagactagcctataaggagagaagagactacaagagtcttcttaagaataatatttctgattgtaaattactaaagtgacatttggatttttaaacatcagtctccattaaaacagattgtatacctgctcatgaaatgaaaactgagtctttgtatgttgaccaatcaagtttgtgagcctccaagatccccatcaatgtgaataatgaagaattcacaaaagtaatactcttttaaggatttattttgcctaaatgacacattacctcagtacatgtcttttcctccaagtgcaacacaaaaagggagaaccaaagcatattatatctcactcagtgccctcaactactaactcaataggcaaaaagggtggcaatgctgaagtcaaaacagcaaattcaaactgaatagttaaatgtgactaaagagagaacaggagctggtttgtggtataagaagggcggaactagtacaggcaaggcaagaacaaaaaaagacttgaagtgggcaaggtggaggtcagaatgaactttggagaagtataatggttactgcatgtttgcacatgatcccagaacatccctgagggaatatggttaagttcagttatacaggaaagaatagaatgggtcattcaaagttaaaattcaggagtagaaatggagataatttttagaagaaaactaataaaaggaattatgtcatgaatctaacatacctaaaatatgataaaaattaaagagagaccaaactgatttaagaggcaaaattttcagatgaaatattaatacattattttatttatattttcaattcatatatatttgaaataaaatctatattacatataaaataacaaatatgaggtatagacaaatacatatatattagcttagtaacatataatcaactttttaaaaatcaatggggtgagagacctaaaatttttggatactactagacctaaaatacaggtgttaaactgggaggttctactaaccttctagatatagaaagaacttacatgaatgaagccaggattagaaaagcagggctaagagatacagaaagaaccgatccttaggtcatttgagaacccagatctatgcgtgctggaagccaataccaggcttctcagatgcacgagccaatatgctctgtttttgattcagtttgaattcagtaggtcatttctgacagaaaaaagggcagaaaagttaactgagggaaaaataaaacaagttatagaaaaatatatttctatgaccccattggggaaagggcagaaaacaaagttcaccagaaaaaataaagcatgatttatttaagattccagagatagatgttcaatattaggctttccattattttataatacatagtaagcaatagatgctcaaagcatactgaaggctacacatctacttccataaattgaattctgtgaataccaagagttgactttttgtacccctgtttatgaactgttctgtgttcattaatgtaatcatatatgagaattaaaagaaagaatattattagggcttaagaaagacaaggttagggtaagttgcttaaaaaaacttatcttaaaaattaggtataggtttaagataacaaaaaaatcacattataaataccatatacatctcctataagtctaaacttagattgctttacgagtataaattattggtctactcaaaacatacacaaaaatggttatcacagatgatgtcttatgggcatgtcttatgtgggaaaaaaaaagtaagagccactcctactcaaagaaaagggtttggctcaatatctaaagacaggttgtgaatacatacttgtatatttcatgtgcgggaaaaatattatatgtgttattttttcttatacccagttttattaactttttattcaactttttattacaaatatgaatcagatttaagaagccttcaactgtaacatttattttctcaggctcattttacactttacttgaacttggattagaagacttgaactgttaagactttaaacctagcccctattccaaactttcccacacaaaaacccctaaattttataatttagttaaccgagtcctagagaaaaataatgaattttctgaaaccacaaagttagaagcaacaaagctagattcttaactccaggaaacaaagtatagttttaagggctaaataagttattataaaatattgaagaacacagctttaatttttaccatctagaaaaaatatattgtattttgttcctatttaaaaatcattaatgttgttacccttcaaacaatatttcagtgattttcttagtatttaaaaacagtagcaaaatacaattactcaccatttttctactttattttactactctatatataataaagccctaatgtccgtaacattctacaatgtgttatagaaattgatgagtttaattacttaatgtgcacagatcaattagaaataaattgaaaatgaacatactgtacactctacttaatctcgttatagtttggtttcagaattcactttctaatttgaaacccagtatgttacattttaaaataataattagaaaacttttacatttcagctaaaataaagcaaaagaaattaaggtaggtaaagtttgattagtcaagaaatctgaactcaagggtaaaaaagatcctatgctcctataatctaagccaatacgtttgacttgtcatactcattttttttcttaaaaatggaatgaaataacattacattttctgtctataggataatttttaaatgaattataggcacaaaaggtagacaaactaatcagcagacaaatgaattaacaaaggaaataatcattcagtgtcaactctatatacttaagacaaataatacacatttatccaaagtaatacaagtatctgcacaaggggtcacacatcacttttcacattactgagccattttaaaacagaaggtgataaaaactcttagatgcctatgaactcaatttacatggagtacatcactatgcttttttaaaatgcgctcatattcaaatctgagaaacatgattctgagctcatcaggcctgcttaattgcactaacatctgcaatcaatttaaattctttaagatagtctttcacagtgcttgaagtgatttcctgctgtgatagatttaacacactcactaatttatagacatatacaagcagatgagacctatttttccaggggtggggtatagtactgaagggcagtctgaatttcccaactatcaatgggattcagaaagggatgcatcctgcataactttgaaactacataaggaaatgataacactgcataagcatagcatagaaattaaacttaaaactatttgtaggtcatggaccattaagaggtttaatgaaagtttatggatgaaataacagcaaaaccaagagctaacagctaaaagttacatagaaaaatgtcattattttctaccctaatagttagggcagcgggggtgctaataaccctgaattgttttttaaccaaagacataaattggcatagaataaagaaaagaatatgagattcaaaatcagagactagaggagctaggcagatggcagcagcaatacagttttgaaaactccctgatctcccacaaaaaaagacaaaataactaagtagcaaaatcaaacacccaacaatattgagtgacaaagtaccttctcaacaatcctcaaactacaggaggttgaagacaaaccaccaacagccacaaatccgcacagtagcaatacgtgtatgggaagaaccaaaggaaggcaacagagtagctaatgaacatgaaaacaagataactccaaaatggcccagagatatccattggacatctcagtagaccaatttgaaagcagcagttggaactggaaggagtatgagtgactacaagaggcccagaaaagatctgaaggggctggagcactcaatgtcccatgagttgccagagctccttccagaacaggatcctacattgaagagaaagtgctgaaagtgaaatcaaaattgagcagaaaattcctgtaaaagatgaaagacacctcaaagacaaacctataaatcaaattgtaacttacaatttcaaagtgagctaacagacattaagagaatatataagacatgaaaaaaatatttaaagtggactaagacacactcaaaaatgcagtgagggaattcaagaaaaaaatagaaataaaaaaatcatttcagaaataaaaactaacaaggaacacaagaataaacataatgtcataagagaatgcagacatgaaaaaaataaaatgtttaaaacctaaatagaaataaagaataagataaaaagcatttgggagaagacggcatattaaagatagacaaaaatccaacatacagataacagaatccatgaaaaagaaaaccaaagcaaaaaattagaacacatcagtgaaaaaaaaagaaatttaagaaaaaaagaaaaagagcatactgcatacttgataatcctaactcagatatcccagagaaagaaagacattaatttataactaaaagttagttatcagctgaccttttgacaacaatgccattaagctttttgctagaaaaaaaaatagtattattcaagatcctatagtattattcaagatcctaagcaaaaaaacgtgtgagccaagcattttatatccaacaaagctgactaaacaataaagggcatatactattaccaacatgcaaaactcaggaaatactgtttccatgagtccttcagaggaatctactaaagaagaaacttcagacaaacaaaaagtctgcagaaataacataaggaccatggtgagcattcaaatatagttactaaatgaggttaaaactaaatgagaactaaaaggaagagtgtgaaatgtaatggctatatgcttagtcaatgtcgacatagtaggacaaaaatagcagttggagacagaacatatgcaaaataaaaactttttacatacacatccacacacgcttttttagttttctatttctccactaaaaacagtaattaaacaaaaagaacagtaagtatccttggccctcagcttgtaaactttgaaatatcgttccccaccctaaaggaaagagtcaactgataccaggtctagcgggctaaatattctagaggaggagcttgatcatcagatcaaaatgactaggagccaactagacaagtcccaatggccaaagatgggacaatttgatcttcactaaaaataattgtaacacatcaatttttaatgatattaaaaatgattgatcatcttcagagaatgatagagaatgaaatcaatatattgaaagctggcaaataaaggaaaagaatcaagcatttatcctaaatttcctatatcactggctaaccaaacagtatttgagagatgtctctttgtaaaagtatcccaataaatgaaaatgaaattatagaattctaactgcaaactagatattaatgaaagaatataatacttcttatgatcttggtaaagagatgaaacctgagtctgatcatgcctctagatctagctgtctctgtgcaggaaatacagaggataggaaaacacgttaactttaccacaaatacacacatcagcaaaattcagaatgtcctggataaaataactgaagattaaacaagacatagagataatccaaattttaaaatataagcaacagtagtgcatttgtggcccccatggatctatcacttgcttcaacagtgattggacagaatagaccaagggactccctctcaaaaaaaaattttaaataaagaccaagcacggtggtgcatgcctataatcccagcactctggaaagctgaggttggaggatcacttgagcccaggagttcagtattacagtaagctatcatcactactgcactccagcctgggtgacagagcaagaccctatggatggacagatggatggatggatggatggatggatggatggatggatggatggatggatgaataaactatagtctgaggatgcacttttgagtgatagatagatagacagatagatagatagatagatagatagatagatagatagatagatagatagatagaaagaataaactatagtccgcagaggcacttttgagtgataaaactagaaagaaactcgaggaaatgattcccataaaagtcaagatggtgattacttttaggctaaaatatacacaaaactgaagaaaggtttagcatgggacggggcagatggagggctttccaggatgactggcaaggttctatttacttatctgtgtggtattctccttatgataattcattaagctacacatctttttttgatgttttctgtaactatttttattcgacaaacggtttttttcttttctaaaaccctagtttctagtcctagctatggcattaatgtgggaaagtcacacattcccttggaccattccctcatgtgcaaaatttaaagatgctgtaagatatcttccagacctaaataaaaataaaaaaaagaactactactaaatatatctactaaatacgagagtataacaaagtcatccttaacaaaaatgcagaaaaaaggttttaaactcaccaaagtagcacaaagcagtttcccaaggaaaaaaaaaatccacaaataaaatctaccataacagtaatatacaaggaatagtcaaaacctaagattaaagttactgttggactatttggtttccacatctcaacaaatcctaaggacagatccttaatttacttaatctactctggaaggccttctggtaataaaagcatttgaaaaatttttgcagcatattgatagtaagaggctataccaaccatatttattgtcttgagggttgtgggggaaaccactacactgagccggttaggaaatggtaataagtcaggaaaccattaaattgggaacaaatgccttttgggcatcaaggtgattgattagcctattaaggatttttttttaagtatgtatagaatttatgccctttaggaataactaagaaatcaaaggatatctcttaagtacaaaagagcttaggagtttaagtttaatgccaccaactaggaaggtgagtaaattcacggaagctttaaaaccaggcatactcttctccttactaatatctgttctattgggcatctttttccaaaagaaagcaggttcttctctgttacaatagttaaccttctcctttgattatttctactagtgaccaaatgtcatagagaatttcttagcagctactagtatgtatggtacttgaacactcattttgatgttatgcatatggcaaactatccttgaagccaccatgactagataatagttttaatagtaaatggtccatgcttagcctttaaattctgtcaattcctggtctcttgttaaattaatgttatactaagagacatctggtgataaggctcatcttctgcagcccagtaattctcattctcggctgtatcctagaatcaccaggagggctttactcaatattgatacctgggtcccatccacaggaactgttttatggaagtgttaagtggtaaggcctggacattaaaatacttaaagttcccagatcattctactggatatcaagatcaagagttattgctcctggatactttttcctcatttcatcaattacttagcccctttgttcactgaaagacacctgcacatacatagcatttattttcttaaattttcactttttccttcagaagtgttccttcttttaaaagcttctttatatttgtatatacagatgtcacatgcctcttgtggcactttcaaacttatcactacattcatggttatctgacatggtaagtttttaattatattcacaaaaatctaaaaagtaagtacgagcatagcaaaatgtcttaggccaagaaacaactcagtgacaagatgaaaacaactcagtgacagggtgaaaatgaccttggatgacctctaatgccaacaagcggtataaacatcattaaccaactcaggatctaataaaattcaactagtaaatagcagtttttccatatctgatgaagccttttttaaaaaacgctataataaaagaaaagctgtcttaactacctatacgatttttaaaagaccaaaagtatacaattctaatgtgagcctaatataatttactcctataaaaaaagaaaagatgatcagtttcttcattatcatctcctacctaaacaaaaacacaatgcagtaatactagagaacatgaaacaccactggtgctgcccagaaataactcataaggaatctggatgaattttagctgttggaagatcattttaattgtgcatacataaaacctaccctatataggaataaatgaaaactgaagtgccagctagattattagaaaatactcttaacaagaaatcggttcattgtgctgaggctctgaaattttctgctagtcagcaagtaagacctggaaacaagcaggcaaagcatcataagcaagggcattgtgtttattagatacatctaatgtcaatcacaaattttttactaagcttttgtgttataggggcatttttatcaaatccctaatcggaaatagaagcaaaaaaaaaaaaattcacgttaatgttaacaagaatgtgtgaaactttggttcttctaagtttctagtggttaaaatataagcctcctttaagtaagaacaaccaaaaagtgagagaaaataaaaagaacttaatttacttgtaactgacaatgttttccaaaattaacattggaaactgtaactgaaagcaagaaaaactgacactgaaatgtattaaaactccctactaatattacaatattaacaaatcaatgctaaaactaacaaatcaattccagattttccatgtagagaaaatacagtcaccccttggtatccatgggagattggttccaggacttcccacagacaccagaatccagagatgctccagtctctgataaaaaatggcatagtatttgcatataacattcacatcctcccatatactttaaatcatctctagatgacttatgatacccaatacaacgtaaatgctatgtaaatagtcattatattgtttagggaataacaagaaaagaaagctgtgcatgttcagtgtagacacaattgtttttccaaatattttcaacctacggttagttgaattcatggatgcaaaaccaacccatggatacagaggttcgactgtatacataaatctaaatatatgactgatttttctcaaaacatagttcttttctgatcaagatacgcctagaagagtaatactgcagaatacaatgtcttccatccttgagaacataatggcctattgagctagagcagtactatgacaagacctttcaaaatacttttaaacactatattatacatatatccatacacacaaatatatacatacacacaagaaactataattctacacttatgaactcaatttagactcagttgtttcattgtgttgcttaaaaaacttttgttagtctttatgcctcgtaaagttatgatcattaatacttgatatttaactttcacatttaaaaagtctgaggaagaactactacagtaatacttaaggaagcgttcaaagaataaaaactttatccaaaacttttctaataaattcctcagaatagcccttacattcagttggaaaccagcttgacagggaaaaagaaggagctagcaaactttcaggagcatttataaaagaggaattctgcttcttgatccaaaatatcaaaaaaaaaaaacataaatagaaaataaagaatggatgttctaattaagaatcttagaaatgtgggatgggctatccttcgatatcagctcacctaaactgggcatgttaatgcagctgtaatacagatgccaatgatacgtggataagggaggtgaggagtctatcacaacttctgactccaagctagtgcattcagaagggcttttaattagaagtacaaagttcaaagagaaatgtttaaagcattttatctaaacctaatggtacagccaaaaagtaaggggtggggcacgggggagtgcaacatgctaagaggtagcagtccagttgtaatctgtaggtagttaaactgtctggacagtttaatcatcttgacctacgaaaattaattggggaaaaagacaactcgcaaagcactgataagcaaatgttcatctctactaagtattcttggagacacaataaacacactgcactacataacataaaccaaaattcccccgaaaatctctttaaatatctctccaaatctctcccagaaaccccacctccccacaaaggaccagacatctttttggttctcctttcctatctatctctcaaacttgtcctccttccctctatccttactccctctctgcccctctgcttccttcaagaatctgctgctcctttcaagggtctgctttcacttgtctggaatataggttttggcctctcaggacttccctagtttcatattgccgcagattacccggacaaacctgaaagtagaacggcaaatagaagactccttcctctcaacagataggaaaggtataatgtatgtttatttttgaggggcggggagggggacagggtctcactctgtcacccagactgtactgcagtggcatgatctcagctcaccgcaacctccacctcctgggttcaagcgattctcctgcctcagcctcctgaatagctgggattacaggcctgtgccactacacccagctaatttttgtatttttaggagagacagggtttcaccatgttagccaggctggtctggaactcctgacctcaaatgatccacccgcctcggcctcccaaagtgccaggattacaggagtaagccaccaagcgcagccatatattttatttttactaaccctctgtaattgatagagaaaaaatatataaatcttgttcagaatagatttagatcaataagaatcctttttaacacatactttaattgtatataaattaatccatagtctcccatgacccccatcatgagatttttctcacattatccagaaataatacatccagaaacagctcacctttaacacaactcaagcacctacaagaaaataagcattaataaacacttctatcacagacataggtatgatgcaccatcccaaagagaaaagaggaaaaagaaaactaagtgaaggcagcaactctattaggatatatcttccatgcttggtttgtccactcaaacataagaagcttgactacagaaatcatcttttaacagtatctgatggagtactttaagcattctaagggaagataagattaaaaataatcaaaccctaataaagaatgagaactatactcaaggttaagcattactattaaatacatctatatttatataatagatttgtatattaatttctaattcttttttatttttaaaaataatgaaaatcctcaggcagttgtggtttacaagagcattctctgttctggtccagaattttcttgttcttacatttattggaaaccatggatcctcttccatttggcctatcacatcacatcctgctatcaaggcctttaccactaactgcatcacagtcttaccttccagctacgtgatctaacaagtcaagtctatattcttcttaaaagacattttctccaataaacttgctgttaaacatctgagttgagtcatttaccatagaatgggcacagcgccttgtagtacctctctcatctatgctatgagtgagcccacactaagtgaggggagcgtcttaaggatgctcctttgaatggaaacagtaatttccagattgaattagaattaaagatccagcacaggcaaaaatgcatgtggatggtatatcaggactctttaacagcggcaaagaaaaaacccggagtagcttccatgagaacctgcatcacttcacataatgaagagtctaggggcaggaatgcattaagccagagaagcagctctgtgacatcaagcaccgtacaacctctcacaatcacatccaatggcggaacaaagtggctctccaactctggatcctttcatgagggagggaaacctttctcaaaaaccccaaagtggaactgcccaccagagtgtaccggacaaacctggatcacgttcccatgccctgaaagttagaaaaatgtaaatctggtattttctgcttctaaatacgacacttccttaataaaattgtaatcattcttcctaactgcacaaattcagttttattcttgtgccacctaaattcaaacttaataacgtcttagaaataacctagtttgattggtggcttttttttttaattctaaaaaccaaccttatctacgttaggcctactttgagggttaatactttgagggttaagtattttcaaaccatgcactgttagacatcagtactattttcaaaaaaataatattaatgcttacccaaaaaggagaatctcaaagcaattctaagcctaaaaccataacaaaagtatatcttttttatcctgtgtccttttcatatcctgtgtagaacaatgtatccataaactttgattctgttcttttcagagtagctttttcaatagtcattaatgtaaataaagtggcatgacaaagtctgtaccctagagttaataaaatgtgtttctacttccagagcaaaaacaaatgactggtcagcttgaactttctagaatgttaaccatctgccaaattattcagaaccttcctaggaagagccatgatcctccacacactaattaaatgagtcaatgctgtaatcacactttagataactaatctatttcaatcctgataatttaattacctaattctggtaaacaaatttcaaccttagtccaaaatgattagaggattaaagttgaaaatcagtgaatgcaaactgaaatagatccacataacaaagttcaaaacagtttgtttcttaaaattatgtttattatctcaaattcaagaattaatatgaactatcatgccaaggttttctaaaccagttctaactgatgtcgtatctcttataataaatgaattcctacttgttagatttacaattccctaacagggtagtcttcactgactacacaaaacataaacactatctacactcaccagtctgttattttttttccacatcacatttcacctcctattacatatatgtttatgtgtttctgttatgtacatccagtgctgcttcacaggacacagtgatagactatcgtcacacaccatctctagtgcctaaaatgctgcctgacctgcagtggcacgatctcggctcactgcaacctctgccttatgggctcaagcaatcctcccacctcagcctcctgagtagctgggactacaggcatatgccaccacacccagctaatttttatatcttttgtcaagacagggtcttactatgttgcccaggctggtctcgaactcctgggctcaagagatctgcctcccaaggtgctggaattacatgcgtgagccaccacacctggccttatagacacttaaaaaacaacaactaaaaaaaagccttagaaatgtgaacttacaaatagtaaatctgtatttttactgatgtacttttctctatattttaaattatggtataatgattacaataacaagaacaaaaaacaaattacaaagaaaaacaaactattgctaccaccactgctaccacaagaggcagtcaccagtcataaaatatgttgtgttctaatcatgaaataaacaatttaattttgtttttattattattattattttagagacagggtctcactctgtcacccaggctggagtacagtgatgtgatcgaagttcactgcagcctcgaactcctgggttcaagcaatcctcccacctcagccacccaagtagccaggactatagtctctcatcaccacatccagctaatttctttttctggttgagacaaagtctcactatgttctccaggctgctctcaaactcctggcctcaagaggtcctcccaccttgacttctcaaaccaccatacctgcccatttaactctgataatgagtccactatgtaggtattcccattttatagtaaggaaattgagaatcaaagaggtaaaataagatttccaaggtcaagcagagacacataagcagatccaaaacaccagagctctgattcttaaacccccaataccaatttgtgatatataagtatcattaaaggacaaaggcaattagtatcagtatcatagtagcaggatacagagcccatctatatagagagctaaaaaaaggccgggcgcagtggctcacgcctgtaatcccagcactttgggaggccaaggcgggcggatcacgaggtcaggagatcgagaccatcctggctaacacggtgaaaccccgtctctaataaaaatacaaaaaatttccaggcgtggtggcaggcgcctgtagtcccagctactccggaggctgagacaggagaatggcgtgaacccgggaggcggagcttgcagtgagccgagatggcgccactgcaccccagcctgggcgacagagtgagactccgtctcaaaagaaaaaaaaaaagtgccgctaaaaaaagcacagtactcacagtgatttctatacctgaagagcaagctgccaaaacatgagacacgtttaaaaattaaacatcacttgtgtctttcttccaaaagaaaggcctcagagtcaatgactggtctagcagttaagtggagttaaagtataaataacttatgttcttgtaacctgaacttaggttaaaatacccaaggaaaactagtgtgttaagctactttttcctaatccaattctgttgtaaattgagccaaaatcattttccactgtctttctactgattgcttcttcattggcttccattttatattttcatccaatccatttattcacaatttgtatgtgactagtcaagctcatttgttttccatgaaataaatgcaattgattctgtgtgccagtcatggtttcttagacatttagtcattacttccacccacatatttcatgtttctctagaaaattggcagccatgtagaggcctaatgctcctttcaataccaacatttataatttgttacaagataattttattcatagggagactcacattaaagacatttctaagccactattatgtaccttgatgtagacagagtaaaatcggtctcacttttctataatgcagatatcactgtgatttataagtgacattaaaaatcaatgactatattaattcactaacaaggaaaggtgacagagtagaccccctcccagtgtttcttagcaatgtaactagctaaaaaacagaagcagcttaaaagttttaagatgagaaatatttttaatttaaacaaatgtataatatacttgtgcccttaattatacattcagaagccctctgattacagttgcccacaaacttaagtacttcattagataaatgtgctgttttccatgttaaaacatgttcggcagtatttttcaacttgacagttttacttactgtcttagaagcagtattaatgtactgcatcaccatttcttttttgatactgaagtccttttcccgcaatggtgcctttttatcttcatttaaattcatatcttcctggaaaacacaattaaaatgcctcattttagaatctaagtagagcagcaattctacatgcactacaaatggaaaaatcaataatttgtgactaaagcagcattaattgttttggaatgatttacgtgtagttctgcctgaaggaaggagagagaaaagaggtggagagggagagaagaaagtattctagatcattttaacaggtaaaacacttactaaaagaacttttaaaattcacagcaggcaaataaaattatattcacataactatagataattagacagttgcagatttctgccattcataaggtcacacaatttcaatatatttatttatttttacaacagctgcacctgaagctatcttccactgctttgaaagagctgctctgtgtgtcataaaaattaaaaggtaaataaaccaaccaattttcagattctgatagccacatcaaatatccagtactggttccagcaaaagacaaagcactttatagttttgtcttttccctactcttatcaaaaatgttaactaatttattgaatgttctaaattacataaaagttgtacttataaaaacagctaccacctaaaatcgaacatttctcaacagcaccaaccaaaataagggtttaagtaactaagatcttgctacaagcttaattttgactaaaaattcaagtcaggtatatatccacataaatatatgaattgctcttaattaagctcctgaagtaagaggctattctggcaaaggaaagggcgcctgaggtaagacagaaatggctaaaggagaagggcagctcaaatgaatttcctcgtgaacttagccctgagtcatttgtgatatgcaatgtaaaatatctgaatgtatataaacttcgtatctactcagaatggatccataaaattcaggactttggatcacctatggagcctagcaagttaaatttcttacagattttataagggtgctacattcatcaaacgctgtagtttatgcctttagctgactcaattcttggctaccaaacccttcgagcacttaaaagtcaaaattcccttcattttaccttgatagaaatatttaagatcttagaagctgttccatttgacactacgataaaaggtagtaattggcaatgtcacttttgctgctctagttagaaacacaaacatcctgttacgtgaataagtgtttgttttgtttcgtttttttctctaagctagtgagagaaggctcaataggccttaatatgacataggaagcattttggaaattttggaaacttctggaggcatgttagttgtcacaataattgaggtgatgctaccagcatttacagggggtagcatcacagtttgacctgtacagtaaaaactaccttgtgccccacagagagattcacacacctaaaaaagagagagagaaagaatcatccttaactaagcctagactcgaattcaatggaactgttgcaggacaggtgagccccaaatttggggctcatggcttcatcatagaaagaattcaaaggcaagatggtcgtgttacacagcaaccttttatcgaatggtgctgctccttgcagagcagggctaactcataggcagtgtgctcagagtcagcaatgtatgggctcttggcaattgtaattatactcacttaaactcacttagctatatgcaaattagggggtgggtcaatgtaaattaaggggtgggttatttagaattttctaggaaaggggtggtaacttctgggccattgccatggcatttgtaaattgtcatggcgctagtgagagtgtcttatgctaattaatgagggcagctagggattgcttttgtcccatttgccagttattgctgttttttgtgttttttttttttaatattttagtctgtctggaccagtttctgttttgatcagcagggttgtgactagaaaacatgttctgccagtctcctattccagaaatagatgtaaaatgtaaaattattacatattaaatactttgtattgcatagttttactttactgaattttccaagaatcaaactattctgtaaattatagttacactctgctttttttaagctttaccaacagttgtgcttcatttctgaaatgtaggtatcccagggaaatactgtctgtggtatctgaatccccaaaatagcacaactatatcaatctaccaatctacaatgccactgctgtactcacagaggtatgaagcagagattcaagagtatgaatttactataccttcttgagtagtcatggccaattgtttaaattgaaatacatattttattatatagtagagtaagacatattgattttcttaatttatgaacataggtaacattatccacaaagaatttcactggaagaaagtaatgagatagttaggggataattgttataaaacgtggggcaatctgagagcactggaaaattctgttttaaattattcactttatttttattttcaggctaatggccaaacattacccagtctctttagtaaattaaaatacttaatatacacagaataccaaaaaacagaaagccctttagttgtggctgaaattgaaataaaatttcaaggtgagtagtagaaagaattttttaaaaaggcctctgctttctttttggaaagacatcttcatgataacaccagttcatacaaaaaagtggttgtgattgttatttttgggggttggttaattttaggtgtgatggttaattttaggttagacttctggcttaaagtatacccacatagctggtaaagcattatctctaggtacgtctttcagaagagattggcacttgaatcattggactgtaagtcagtaaggacgatccgccctcagtatgggcaggcaccatctaatcagctgaaagcctggatagaacaaaaaggcagaagaaaggctaagtctccctctctcttctggagctgagacaaacttcttctgcccttggacatcagaactccaggttcttcaagctttgggccctgggacttcccccagtgacactctccctggagttctcaggccttaaagccacctcagcctccaactgagtttcaccaacaacttccctggttttgaaaacttggggccttaactgagccacgctgctgacttccctggttctccagcttgcagatagcatactgtaggacttcttgccctttataatcatgtgagccagttctcctaataaatcccctctcatatagacaggcaggcatcctattggttctgtttctctggagaactctgactagtagtgatacatctggaattaagggagaaacccaaaattctcccagctgcttcctctggtttatcccacctcttttgcctaaatatggcactcgccttcctgacaaaagtatgatgacagtcctagtataaaaaaccaaaaggaaacaaataatacttgctctaatttggatgttatcccatgcaaatctcatatttaaatttgatccccaatgttggaagtagggcctagtgggacgtgtctgggtcatgggtgcagctccctcatgaatagattaatgaccttcctggggtgggggcgattgagttcttgccctattaattcccatgagagcaggctgtttataagagtttggaacctccccaccaccttctcccttgcctcctctctcaccatgtgatctctgcacacaccagctttttcttgtctttcatcatgagtggaagctccctgaggccctcaccaaaagcagatgctggtcccatgcttcttgtacagcttgcagaactgacagccaaataaacctcttttttaaattattcagcctcaggtattcctttatggcaacataaaaatggactaagacaacaatacaaaagtttggaatcaactacataacaccctaaacttttgtgggatacccactaggcatgtaacttcatctaacaggtcatcctccatatttccaggaggaaatggcatttgaaagcgtaagaaaagctctgccctttaaaaaagaaaaaaaaaaagagagagagagagagaaataagggggcagtagagagaaaatatgcatgaaagcatgaggggtatggtattattagaatatattttgaatttctatttatggaaaacaaggctgaaagaagaaaactccatgaggcagtggcacttaacttctgggggtcacgaagtccttagaaaatttattgggagctttttttcctaaaaaatgcatatccatattttatgttgcaattccagaagggtgaagcatctcccaaggctatctaagaaactggacttggtgaaggtcagtgggggagaagtgagcaagttatcattttttatgtttcttagtttatatttcctcaaaattatcatgttgtatctccattatctaaggtcagtttcccttaaaagcagagcctgaaacagggattcaggtgcaggtggggctgctctcaggataagaaagtaaaggaggtaagacaaaagaggaaaaaagacatactaaaggtggcctctggtggattctcacttcaccctgagatgcaccacagtcaggatagcctggtagcagaaaccagcctcaacaacctcaagttagtcatcagctgcagaatcctagttctgatgagggcaaatctctggagaaaggggcatctataagctattagaagccaacactcatcacctggggcatgggtgcaccagcctggtaaaaaggagctgggagggggtactaaaagtacctactataccatctgaaaataatttacttgatattaaaataagacttctttcaaattgaaagaataaatatagaaacaaattgaacagaataaattgaacagaataaatatagaaacacatatagctgaccttaaaaaaaaaggcaatataaactattgtgtattaactcctccttccattcaaacacaggtcagtaaaacatgctgctttactgtgctaccacactacataggtacaaaatgacactgcagacacagattgtaaaacggctctaaaatggctgtttacctcaatatatcagtatgctgatatatgtacgtatctcattaaatatctattataggtaaaatactgaacaggaaatacaaagtaaacataaatacataaggctcagtgagtaatctgaatgaggttaaaatttccatggatatatgaaataaatctctaccctttaaatggaaaaatcttatcaactggctattgggctgaatatatcacactcaaaaacatcatttgccaagtcacctattcaaaattttaatctctctgaagagcatattattgtttttgatgttaaagttctattaaaaagttctattaatatgttagtaatatacattatgaattatctcattcatagtactccttaatatacagatgctcaacttacaatggggttatgtcccaaaaaagccattaaaaattgaaatgcagaaatgcatttaatacacctaacctactgcatgtcacagctcagcctagcctcccttaaacatcctcagaacacttacattggcctacagttggacaaaataatctaacacaaatgctattttataataacattttgaatacacagatgcacattttgtagacatggtgggatgcgaaaacacaaagcacaatatccaaaaaatgctggggacacagtacagtcagttgttcagcctaatgattgcatggctgacaggggagctgcagctctcagttgctgccccacgtcacaagagagtgtcaaactgcatatagctagcccaggaaaaagatcaaaattcaaagtacagtctctaccgaatgcatgttgctttcaccactgtaaagtcgaaaaatcgttaaatcgaaccactatatgttggggaccactctcggcttgccaggggaaaccgagttgcaacagcaaaaaaaatagtttccctttggccaattactttctaattaaaatctatatctaaacagaatcactgtgctgatctgactagcactaggaacagatttcagaagtacaatacttggaaagctttttttttcattcaatacgtgggaacacagctatgtcatccaaaaagactagaattaaaaagaccaaattaatgtggtaccagaaagtaagagaaggaaggaaggaaggaaggaaggaaggaaggaaggaaggaaggaaggaaggaaggaaggaaggaaagtcaaaaggacatgagccaaactgaaagagctgttaagtggccaaaactagaacaatttgaaaaataaaatgatagtattagattataacctaaaaagcaaaataaattgaggagatactttaagactgtgcagatatcctttttctccttaattatagaggggaaatactaactttacaagggaagaagctggcagatgccaccttaacaaagttgtccaggctaacaccacaaataataggacatattgatatttcaaacctccagctatgatataatgagaaggctgatcacctctgtggtatttatcccaaaatagatctcaatctaatcacaaggaaaaaaaaagtcaggcaaacccaaattgagagcaccctacaaaataactaaccataacttttcaaaagtatcaagctcataaaagataaggaactgtcattgactggaagagacatgacaaataaatgcaagatgtgatcctggattagatcctggaagaaaaaaaagacatgggtgggaaagctggcaaaatctgaagcaagtctgtagtttagttagcaatatcgtctcagtattcaattcttagttttaataattgtactaatgttatataagatgtaaacattagaggtagtttggtgaaaggtatacaagaattctctatactatttttgcaattcttctataagtctaaaattatttcaaaataaagagttattttaaaagactaaattgaaatattttaatagaactttttataaataacttggggtaaaaaaagaaaaacagaacatcattattaaaaaaaaaaagaagtttttttatatcccctaaataaaaagaagaggtttgtagaatattcggctatagtaaatacacactgaattgagggaggaaaggagactaaggaaaccacaatcaagacaaatccaagggtcctgagaggaagggttaagtaggtcagacacaggtaacagaattccattcaaaacacaaacttctccaactgtttacatttcctcctattttcattccaaacctgctctatgcactgaccttctcacccattctcccagaaccattttacaaagacctctagtactcctgtaatcttaaactatggtcaaattcttgagccaggcactgtgctaaacattcataagcattacttaattaatcctcagtaacttgaggtatgtcctctttattgaggagagagctgaggtttaggaaaattctgtaagttgaccatggttctttaacttagatttaaactctgttctatctcatctccctcattcttatttccatattatttatctatgttatcatctaaagtccgatttccttggggctagtaacatctgactgaacacttccactgccatcaacttgggttgattcctctgacactccacaccttgctatcacccacaatggccctaaagcaagcttgtccagattgcacccaggacggttctgaatgtggcccaacataaattcaaaccactttcttaaaccaccatgagatatttttgcgatttcttttttttttttttagctcatcagctatcaaaagtgttagtgtattttagttgcggtccaagacaagtcttcttccaatgtggcccagggaagccaaaagattgggcacccctgccctagagtgtccttggcttccttgccaatgcaagcttcacttccactgtcctcagctacagtcctaatgaccacacctggaccttttcattatctaaaacctgtccaccacaggcatcatcagaatctccataatccttatctctgacctcaatcttccatcttgccacttctcccactcccaaaccatctttttcttggccccagtaaaaacctccagtttcttgacccttccattttcttccaatgcaggccactgttgattcatcaattcttacaacatttatggcaaatcttactagtctctctcttttcacatttcatatggtacttatttcaaaccttagctattttcaggaactgtgaaactactacttctgcctatcaccctcagtaaataaatttcaattccctatatgaaaagaaagctataattccattttctgctgttttaccattttatttgcacactactatctttccctacccaaccaatgcatttatccaaagacattcctattcatttatgctcgagatcccttttcctcccacctcaagaaagggcattacacatcgattatcctcttctattttatttcactaaattctctcagttggttgagtatcaatatgtaagcaagttaatctttaatggattaaaattaaacaaaaaaacttccctcaactctggctctttatatgtaactcttttctccctcaccgataacatttaatagaaatatttctatacttgctgcctctttcaccgtgcatggaacataatggtcactttttaaatatttgctaaataaagaagatgtcagaaaagttctcaaatagaatttgctcatcctattttaggacaaacatgagatgcaggtaagcttctgggagatggaactgaagctggagatgatacagccccagactagaacactgagcaattgctgctcctaagaagattctcaagaatcttcagataacagttacgggaataagttccaactctggaggtagaaatcttcaggtcgtggcactgacacaaagatggccaagctaaaatccatcactttttcagagaacactagcagacccacactaaacctcagtgacctagaacagagtcaatataacgactgacccctgccaagtagtacctggttgaggaatgaatggggtcaaggtcccttccagactcacttcatcatctattccaaacttccaaacttgtgaccttgtgtggtgctgtgtccatccagaatgaaagcatacacctattctgtaacttgcacaaggacaccaaattagtcagcggcagcccttacctggaaaccaggtcaatcaagcaacttttaagatattcccaaagagtcttcctacaagttgcatggggccagaagttcccacacaccagcaaattgccagtttgctactgtttttagggaccctaactccctactagactgattttttaaaaatagtaccaaataaatatttttcacattttattagcaaaaccgaggtgggggggaaatatgtaacttagtacctgtgcacacacatgcaactcgttggagcactaaggcacaatcaagcagagaacagcaatgagagagtggacatttttccaactgaattacacacgttagactcaatattttcattcatggctgtggattttgcaagacagcatgctcattaaatttacatacatcaagttgagcgggacagttaacaccacagagagtcagattaaatttaaaatgattgactatttgcagaattaagtgaatatatacaagcagcaagttgctgaagatggtcaggtggaaggatattcaaccaaaaaggaaaaacactacagacaggcagagcatgactagcattacaaaatggatatgggaaatacagtattataatggaccaataagcataatattggaaaataaaaattagaagcactgcaatagcaaaaccaaacatttattcctattaagtcaacagcaatcatctaatttcaataacattatgttttgttttaggggttaaagccaacataattattcttggtagcagtctctgttttgccagcattatattattaaagccacaaattggttaagcatcttaagaggtccacaaagatcccctaattccctctcttgtgacagagctcaacatcatataagcacaattttatccagagttctgctaaaagtgtaattctgttcttaactacatttgaattcatctttgacatcacacaatatcaaacggtcaagcttttcattacactaaggtttttactaccatgaatggcttagtgccaaataaaaaaaaacagaagatttcatgacctcattcaaggtcattatacactgttgaacagggcagactaaatgaatcttatctagttctgcaatttaataaattttattgggtttagacataattagaaaactaaaagataaatactaccaagaacctggaacttagaattaactttattactacttttctatattcaagatgtctataaatacattgaagctataaaatagcttaaaacagctataaaatattttgcctatcagctttactatgtccttatataaacctttaaataatcatttttaacagaaatatgattatttaaaagttatattttttggttttaccaatagtggggttgaatttccactgtactatccagtagacactggattactcaattcccattaaaattaaaagaaagtcagatggctagctcattaatagaacagcagccaaagaatgacatttacccagagactgataatgaactcataaacactattttttggccaaatattctaactggagaatatgggaagagtgtaaactatcttaattgaaaaacaaatttcagtttatcctaatgcagtatcaaggcacacacacacacacacacacacacacacgatgagaaaaaaagaaatttaaatatcacttttctttcatatactgtaaattttagcagaacagacaagaagagagctgaatattcagaaagctgcacaactctaatttattctggaatgtaaccttgccagaattgttcaagtgtatgcataagcacctacaatcacaaacaactgctgtgtaatcctgcagataagaacactgccagtgattggccaggcgcggtggctcacgccagtaatcccagcactttgggaggccgaggcaggcggttcgttcacgaggtcaggagatcgagaccatcctggctaacacggtgaaaccccgtctctgctaaaaatacaaaaaaattagctgggagtggtggcgggcacctgtagtcccagctactcgggaggctgaggcaggagaacggcgtgaacccaggaggcagagcttgcagtgagctgagattgcgccactatactccatccagcctgggcgacaaagtgagacacgatctcaaaaaaaaaaaaaaaaaaaaaaaaaactgccagtgatgaaaaaggattttcattcatatatttgtttttcaacttttctaagtaaatgacaatttcttcatacatttacataaaggataaaatggtcatttgacttaagatacaacttttttcttaaggccaccttttctacagaagaaaatatgactgagaaaaggccttcacaggtatacacaaataattgcctgcacagctcctaactggcaaaacagcatgctgaaatattaccataacatttacccctttaaaattcctccctctaaccattttattggtgctacaaaatcccaccaggcaaaatccagtacacctaaatcatttattttctcatttatctggatctagaagaaacaactaaacactgacattatccccctgacaaacacaacccatgaatcaacttgataattgccttgaactactatactctctccctcttcctcttcattatttggattgcttttaaaccacctttccctgaatttttcaatttctacccaatggagagggaaaagagtgacaagtaataaatcagaacaaagcattcccacagaacctctctcattttatctagtcaagccttaatacacttttttagattgtaagaaatagaaaatgttcacgatataggaaagtagatttgtaaagaatactaatacttgaaataagctgctggtaggaatctatagcagtcaataaacacttaagagaattaacacaaaggggtctttgttggtttttcttttcattcagactcttggttgacccttaagatattccttgcacactcaacacaaaattcatttatttgaccaaagtaatagctatgcataaatctttaacaccaagaattaaagagaataaagaaagaaaaattgtcattagtatgtaccctaagagtggcaatatggaataagcttagcaagatgaaccctccccacctctataccaaaaatatcaaaagaacatggtcacatctgatttttatcggttcacctgagcccttcttttctcctctggaaaaacagctcttagatattaaggtttattatacagttgtggtgactaagacaacagacgtaaatgcagaactagacaaacgaactgatggacaaaaatcaaacctcagaaacaaacccacatgtgcacaaacttgatctataacattagagatattacaaatcataaaaaagaatgaactattcaaataaatgctgctggaaaaactatgtggaaaaaaattggatccacatctcacatcaggcatagagatatatatttctaataattttaaatgaaaatataggagaatagatttatgatgtcaggatagatttcttcaataatatacaaaaaggacaaaccataaaaagtttgataaatctgaccacaattttacatttttgtacttcagctcccctttcccgctaacaaaagtaaaaagacaagactcggtctaggacaagatatttgcaacacatataaactgaacacatgagtattattctggctatatgggaaattctacaaatcaatatgaaaaagacggaaatctcaaacaacaaaatgggcaaaaatataaacagaaaattcacagaagagtaaagcaaagggccaataagcatgtgaaaagatgttcggacacatttataatcagaaaaatataaatcctttagtatgagatatgctgtttacatttgtttacttgcaaaacttaaaaagtctaatactaatgcaaacagggatgttctacaaattaaccagcctgcaatcttcaaaactttcaaattcataaaatacaaggaaacatacgaactattccagactgaagaagattttaaaaacataactgaatgcaacatatgattctgaactagattcttttgctataaagaggatattggtactattggtaaaactttaatagtgtgtgaggtagaaattgatcagtgttaactttctgattttggtggctatattgtggtcatatagaaggaagtccttacttgtggaaaacatacactgaagtattacaggattatggggcattgaatcagcaatttaccatcaaatatctcagaagaaaaaaggttttgttccgtataactgtattcttatacagacagaaaaaaaaaaggaaagtttcttcagtgtatgggagcaaaactattggattcagggtactgttaacctcagggaaaaaaagaagataaaagcgggaattagaagaattacacaagggatttcacttatatccgtggtggtattttttatattatgttctatactttttgtatgcctgaaatactgtataatttaaaaaaaacactgcaggacaaaattagattccactctatgttatacacagaaaattgtttcaaagtcaaatattaatgcctttggtattatctaaaccaggtttcccacactgaaaagccaatgtatgtattaaatagtaggtcatctaagttcttactaccaggacatacttcaaacatacgcttaagagatgacgatggcattttataaatgtgctttctcctacattacaaaaaagcctgataaacatcttcccagtaaaagaatagaacatcactattcatacttaagtacttcgtgcaattttatcaggtcattttttctacacttacaacaattctagacaggaagtccagaatttaaataatttttgtcagaatgattttggtatcattggaactcatttaatgcctgttaatgatagcattctgatagatgagctttcttgcatagctttcattctctcaaccgatagtgaaaataagaaaaggtatgaatgcatgaaaaaagctatcttccattcattattttaatgtttttgtgttattgggctgactagcaattaaagctaatctccatctaagtatagtgtctaaggtgaagagaaatatagtatcctagaaatcttaagttaggaagctgcacttaacagacatttgtttggaatgataaaccaatggatgatactgcatggatataatctaatgggaagacagatatctaaaaagtgaaaagtaaaaaaaaagaatgaatttcacaatagactcataagcagttttgagaggcaggtttaaggaatccttaactcagcacatgtgaagataattaaagaaaactaatgtttaaactaagatttaaagtatgtataaggccaggcacggtggctcacatctgtaatcccagcactttgggaggctgaagcgggtggatcacttgaggtcaggaattcgagaccagcctggccaacatggtgaaaccacatctctaccaaaaatacaaaaattagctggcatggtggtatgtgcctgtagtccctgctactcaggaggctgaagcagggattgcttgaacccgggagacagaagttgcaataagccaagatcatgccactgcactccagcctgggtgacacagcaagactccgtctcgaaaaaaaaataaaaattaaaaaatgaagtataagaagtctctaacagaggcatggagggagataaatggcagagaacactgcagtatcctagataagaggtcatgaaagcttgaactaaagcaggggggaaataaacttaagagctaatgaagatagagaagtaaatggatgtgactgatgccttaatgagatcaactatgactcccaagtatgacttcagtggggacttctgagataagaaattaagagtgaagcagaaattttggtgagtgggtgtgtgtgttggggggaggtgtgtgtgtatttaggaaatatgatgagttcactttctgatgtgttgaggttcagcatcttttagagagctggattataactgctcttctgtagaagacataccaaggtgtcacaatataaaagatattctccatgaaagggctcaagtctcccaaaaggagtacgcagaaaactcaagtgtataaagataagactgacaggcagaggcaacactgagaggaagtaaaagaacacatagaaggatatggagagtaaactggaaaaaactggccagagagaaggaaaattaggaaaagtgaagtgtgtgtcacagagacacacacttctttcacacggtgtgtgactgccacagaaccagtcaagccgaccaggatttctcacttacagaactataataaatgtgtgttgctttaaatcacaaagtccgtggtaatttgttacggcagcaataggaaactaatacaacactctaggaaaccaatagataccttaggccagcaagtgctcattccttccctcccccgaccccaatctagtcttggaagagacaaattcagtccagagaatagggaagaatggaaaagcaagatggaggaaaagaggccaaccacatccccaacaactgcccctactggagactagaaatggaacaagcttgaacaagggaaaaggagcagctttctttgggtgaaaattaatttatattaagctagggtttgtattatctgaaaccaacaggaaatctctggaacctacctgggacttttaaccaggatcagaagaaaaataagctcagagggctgatttaaaggtgcaacagctggaataaactagccacttccaacttacacctatcatgttcaccttgttcaaaaaacactacttacaggtatctaagagttcaggagtaatcactgaaattgacttcagaaacgtaagttgtaaatgtagtgatgaacacaactatttcacgtatctaatagtcatacagaaaccaatatgggctttcagctagaatttcagctttcaccaaaagacaaacggggggaaaagtctttaagtataactaaaaattcaacaccacttttaagaatgcacacagaaactagactattacccagagaccaagtaaatcaatttcccaagtgaaatgagtatgaatgttgaagttattacactgtacttcacattcattaagtaatcaagtcagcacagtctttcaaaggactgtcttgaggagggaaaagaggtgttcttcaaaacaaagttgttacttcatgtaaaaattactaaatacctttgataatgataaataagaacaatcattgtaaaaattgcacaatgccaaagcaaagaacctagatgcaaactttaaatagtataaagcctctgtaggtacaaatgccaaaaggttaccatggctgattattcaatgttgctttctcaagagaattcttattaataaaaatgtaacagatacgtacaagccaaaaatcaagccagtttaaatctagcattctccacagacatagaaatagctctaaatttgtcaaaaatatggtaccctgagaagtttgaaaaatatcctaatccacatttaaagaaggcaacaacacccttcaaaagcctttcagcttcagaatcaatagcagtttttccctacagagtactgtagtatactcaaggaatcagtaagggaaagaaagaatctgtttcttattttttaaaaagggcttagttgtaattgtctcatcccttagcaaattggacagccctgagaaggcaacaatttcattttatttctgctgagttactccagtgagggtttgatcaccaaaatctaatgccaataggtagacctgcttaagggtgaaaaagtgatctggcccagttattttaaaagtattctgtaaatatttcaaaaatgctgatattcatctgacctctaaataatattaaaatatatagtattagccccctcccagctacgagtaacagaaaactaacataaactatattcagtactttctaggtagttgtacttttaacttgtggaaataaaatgtggcctccataaatgtttaacatcaatgggctacttagtccacttactcagatggcaccctcaattatgatgaaattttttaacttagtagccacaagtgaaccataaaagtgtcatcctgaaatctcatggatggataacctaggtgagtggttcgatatatagtgcacggatgggagaaaagtgcactttacgatcttgagtcctcaaagatagtactgaagagagttaccttcatataggcctcattaacagaggcaaaggctaaccagaaaaaggttaggcatccagaaaaagacgtagaaagtgagttcaagtctccacagatctaagtgttgcaaaaagaacctgtttatcctaaaaactaagaaaagaataaaacaagttaggtctaagatccagcccataacaatgcaaacagtagagcacagtgactgtcattttaacatggactggactcagaccacttagatcaggggtccccaaccccgttagcaactgggccacacagcaggagatgagtggcaggccagccagcattaccagctgagctccgcctcttgtcagatcagcagtggcattacattctcaaaggagcacaaactccatggtgaactgtgcacgcttcttatgagcatctaactaatgcctgatgatgtgaggtggaacagtttcattccaaaatcatctccaccaccccccaaacgctcatggaaaaattgtcttccataaaatcagtccctggtgccaaaaaggttggggaccgctgacttaaatatctactcaagacaaaaatataccgttcgatactttggagtatttgttttcacatactctttacaaaaccaaaacctggtatgttgtttttcttcagatttcatatttttgtaatccaaaaactctttgtggctgaagtgctatcttaagtgacatcagaaattagcctatggagtatgactaccaaaaatgcttagagttccattaacatgagcaaaagctaaggctttttcctcaaacatttcctaaagaatcaaaattcttaccatcattttttcaaaaagttctaagagttcattctctgacagtggctttggaaagttctccatcatctctaaaggtgctgctgagcaatcactgcttgcaaatgcagtcttcaggttgggaagtggaggtctctctttcttgctccctggaattcttatgctggcaaatttgtccagctacaaagaaagacagaatgacacacgtgtaagtatttcctttcccaacatttatctcatctcaaaaatgagaaaaacaaagagggccaatcgtgttatcattgtgatttcatcaagaggcattcagcattggaatatttaaaattaataataataaagagtggtgaaaatttttcagcaaccattctatctaaagattgaagagagctcagacaacattgaaagattccttctaatcttaaaaccacacatagatttgagcttctaatgacaggtgacctttgctttatatattagcaaattaagcagtttagaaagattacttagataatttagtgttggtcccaaactagtactcactgtcccatctcccaccccctcctggcccctctgcctattgccctttccataatgcatcctgtctctcggagtgggggtgggaggggaacatgatttaggaatttttaggaattgaattctacttatatcttcatagcttagtggcctgataaactatttatctttgttcaggctggtctgtatgtgaacttcttgaatatctacagggcaaaatggttaaggccttaagaaataaacctagatttttgttgcaatgaaatttcttctacaactagataatcaaatagcttgctgacattcaaaaaagcatagatattagtttacaaagctaattattcatttattcaaaattgtttgaatttcacaagttatattgctcacaaagaacccagactcatacatttcatgactaatacaatgtttcaacaatcaaaaatgcaaaaagtcttaagctgaaccaggcatcaagaatagaagtatactcaaacagcacagtgattccatgagtttttttttatcattgttgtatacatttttaagctactgttctcaccacgtatactgtatataaacctgtactattcattatggtagccactagctatgtatgattattaaattaaattgaatgatattaaaaattcagttccttcattggactagcctacatttcaagtgctcaagagccacatgtggccagcatactaatacatatagaacatttccatcattgcaaaaagttttaatggacagagctggtatagccattaaaaacgtctgatacctcaaaggttcaattcaaaaggacaattaagtcacagtattgtttattcaattcactaaagaaataggatttcttcaaataatgagatgtaaagataagtattatctttcaaaataggtttctaaatttactatgaagataatgtctaggaaaaatactatgtactgcactcacccatggtccacctaacatcacttaaacattaaagtactaagaatacgacagctttctgtaggatttagaaagttgtcataaaacaccactgctctcattctaaccaccaaaacaaaccagaaaacgtataaagttatacttgctgttgtcgtcaacccaacagaaaactgaagacccaaagaaatctacaagaatcaaataccagaaaatgacaagctgctcttatccctgacaaacagttgaggaagaagaataagttaaacaagggtaaagaaaagccagccaaatatttaaggaaatattgatagctgcatgggtgctggcattagaatttcaaggagccccacatgaagccccagccatttggcaagtctacacccacctaccaactctttccctagtcttcaccaactgaatgcggtagtaagccaatggctcggagcagaacaggaaagctgtatgaatactccgtgaggcatatgcaaacaactgccctccaaaggccatagactaggcaaaagactggagagaaatccccatgacacattctggactttgaaagagcatgtcataatgccatctaaaggctggggcagggtacctggtcaaagagatttcctgaagaaacagccagaagtagaactgaaaacagaaagagaactctacattaaccctaaaatgggcattttttttttcctgaaacgatataatgaagagtggacattacacatgagatgaataatttcagcagcaaagtcacagattaagaaaaaaaaaaacacggatgaattagaaataaagaatagatcggaaatgaagattttcttagatgagcttaacagtaacctggacatagctgaggaagaatcagtgaacctaaacccagatcaatagaaagttccaaactcaaacacaaacaaaataatgagatagaaaaaaaattgagtatgatctgtgatacacatcaaatgttgtaacacaagtgtaactggggtccagaagcagaagagagagtggaaatggtacagaagaaatatttcagaagataatgactaagaattttccaaaattgattacatatatataactcaattcacagatccaagaagctcagcaaaacccaaaaagaatacaaaagacacacacacacacacacacacacacacacaaacacacacacacacctacctacccctaagcacttcatggtcaaactgctgaaagttaaaaataaacagcaaaccataaaactacagccagagaaataaaaatacattatatacacgagaaaaaaatgatatgacagctaatttctcaccagaaacaatggtggcaaaagacaatggaatggcatctttaaagtgctgaaagaaaggtagggttgactcttgaacaacacagggattagggcagtcaaagtccacatataaattttgactccccagaaacttaactacttatagcctcctgttaatgggaaaccttaccaataacataaacagtcaattaatacattgctgtatgttaaatgtatttactgtattcttacaataagttagagaaaagaaaatcttattaaaatcataagaaagaaaaaatacatttacaatactgtactatatttatcaatactgtaagtttacatcatataacaagatgaattgtctgctgaaatggtgaccaacacagctacagacctcaatctatacaattcacgtatcaagcaattcacctttttcttgtaatgtcatgagttttctctgattcttgggatcacttcaagcatcactagtggcactttgtatgggtcccatggtgttactcagggtttacggtattgcactaaacacgatgaaaaatactcaagaactgcaagagatcagtttttactgaaatacgcaatttactggagagattaactgctcaagtggagatgattagtgtcaggtgacattttaagtagatactcaacacacctgagctcaccggaatagcaaccagaggtgactacaacattaatagagtaatatagtgtgcggtacagttaattttataaagttatagtttaatactgcatctttacatttgttcacatttctcttgactgcaaacggcaccatctttagttcatgtttgtatgaactaaagtcaataaattttgattaattttaactttttttataatagatttgtaaatgttttatggtattaagtgagaaaacagactattatttaaatatattcaagatatatataactttttcttttttcgagatttctaaccagtttgtctgcaagttttttcaaattattgcaaatctacaaaaatctccaatatatttctttgaaaaaaacctgtgtgtaaggggatctgggcagttcaaatcaatgttgttccaggatcagctgtactgttatcctgggattctatatacagtgaaactacccttcataagtagaagcaaaagaaacacactttcagacaaaaactgagataatctgtctccagcagacctgtactacaaaaagtataaaagaattttttcaggctgtagggaagtgatacatatataactttttcttaacttgttctgggatgaaatcctagatctacaaaaagaaatgaagagcaatcaacagttgtctattagatgttggtgatacaaagataaatgagctataagacttaccttaaataattatcaagtggaagagacaagcacataggtaattatatagctacacagaaaatgtaggaggtatgtgaaatgtattataatagcaaaaaagagtggcatataactcaccaccataagcgtttcctactctggaataactcagaaacataaaactgtctccacatgaatatatgtccagaagttactatccctatgtacatttgtaccctcattactgatgtttgtttaaaacaaaaacaaaaactgagagaaaccaaaaaaactgttttaggaaatgggactggttacctatctcccaagtcactacttcattgccatcatttctgtacggataatatcaattcctaagcacagaaactattctggttctttacatacacacacatccaaaaaaaaaacccagtgtaacttaattaatatgccaaacttataatgaagtgaaattaagcaaaacttcattaatgcaacatcaatattataaatgtaaacatgtcaataaatgggaataataagcttaagcacttcacaagctaatttgtaaatgcataacctaatggttctaacagtaatagaagacataaaatcttaattttcaccaaaaaccaaaactttttttaaaaagaatctctaaagtcataaaaattaacaatatttttactaatatttactgagccttttctatatgtcaagcaccaggctaagagcttgaaatgcagcatcaggttgaatacgttggtttaatccttaaagtgaggaaactgtatgtctaaaaaataaaagaacaagctccaaaacacttttgtacctaacgatttcatagtattgagctcaaaaataggacaaaggaaaaaaatcagccattaatgctttcaggagtaaaactagtaaaactgtacttgtatcaataacataatttgtaaaagtaataacgttaataataaaatataattatcacacctaccccatatgcttagcacctaaaactctggggaaaagataaattttacccaaatggaaaaataaatttgtacattaccactagtatagacggatgaaggcaagataggaaaaattagcattcccctcttctagcttataaatccacaatggtcaaaatagtaatatgagatacaaaaggatcaatcagtatttcatattttcaatataatgcttttatttcttttcccagataagaaagaataaaagaaaaaaataaggaaagaaccataaaagaaaaataagcacaatccttcctcctatactggaatagcaactcgaatctaatgaatacctgaggctaaaagtaaaagcattccgtgccctattgagcactccaggtagattctacaaaatctgggcactataacaaagctaggcacaaagtgagctttactatcaaatcattttacatgttataaaagaagtttcattttttaaaagagaggttactatgattccattcacacatggaaaaatcactcctaatctatctttgatgaaattgcacacacgatttgcttaaaccaaggtacaatagaacacttgagcaaactttaaaaatactttttacataaaaatatgacaggaatccccctaatattgaccataagttggttatcttgtatttggcaatttggctgggggttgtttatgtgtgtgtattacaatttgtgcactttctatttcatgtaaaatttccataattttatatgaaattctcctcttaaagttgagcaagaaacacaacccagagaggtgaagtatacaaacaatttgcctttgttgaagaattagttaaacatatgcaagactgagaagattctgttataatgccatttggagatggtacaccacacttcattaatatggctttgactgtgtctggggtacactaagttttataaattaatatcacgtatcttcaggggaagctaaatgagcaccctactgagtattatctcatactgagtaattacactaataatcagtaatgacagtttaaataaaattaattaaacaaaaaaaggttcaaaaaaaactatctgaatttttagctatagtatatcactgtaaaagtgaaaactcagtgtttaaggttttcagtattacaacattttaaacaccaaaaggcaagtgattctttaatttaaaatgaaaggaaaatataattagtcatcttacaatttcacaagtatgaaaaactacatatgatcataaacatacttcattagaacccagaagggagtagaaattttcacgaaatccaggagaattattaagcaaacaaaaattccttctcattatagaatcaattctatccaaatacatacctgaaatacagaataaaatctactgcttgaaattctctattttcaggcaatcttacacgacgcttaagagggggtaaaaacctaacagctaacatagcttggctctttagttaactttattactaatctgggaactttgtgattaaaaacaagcaaggctctggagtcttgacttcacaatcctgtccagccacttgcttagtgtgttaccacaactaagctacttaaaccttccatgatggtacccatcacagagaagtgttaacaggaaataaaagtactattcactctcatctttggatttaaaaggctgaaatgccttccctgaccactttatctaaagtagcacgtgtacccaccccttatccgtcacagcacacagtacagtctcttcctatgtcctttcacatgacttacgaaaatctgtaattatctcatttattttgtaattgttaactctgtctctttccaactaaaatgtaagtgccatgctagacaaaccatcaactgttttaatcactgtggcagcccgtctctaagatggccccagtgatcctgatttatgtaaccaacagatattttggaaattatgaagtgcaattttcaagactagatcataaaagattttacagcttttgttttgctccttcttgggagtatgccagctgccagatcatgagaacactcaagaactcctaaggggaggcaaagaacatgacaaagaattgagggcttccactaaaagataaacaggtttcttgccaacagccatgtgagtgagccatcttgaaagtcctggtcaagccttcacatgactgtagctccagccaacatttttaccgcaaactcaaggcagaacccaacccagaaccacccagctaagcaactaccaaattcctgacacacagaagtggtatgaaatgataaatcttggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggtaggagaatggcgtgaacccgggaggcggagcttgcagtgagccgagatcccgccactgcactccagcctgggcgacagagcgagactccgtctcaaaaaaaaaaaaaaaaaaaaaaaaagaaatgataaatctttgctattttaagtcactaagttttggggcaactcgttatataccaacagataacgattatagtcatgttgtgtatgcagcctatagcacagtacctgatagttagcagtcagtcaagtaatacttgttgaaggtatgaatgaatgagcaattactagatgataaaatatataaaacatagttaccatccctacagatgcttaccatttgagagaaaaatatacaataaaggatcataatttaaggtagaatattgtaaatgcccccaagaaaataagccaagtgaactagcaacaggaatgaatgattaattctagagtggggaaaagtaccttgagaggggctttggaatgtaagtacaacagggaacttgtgatgctgatatgaaaattatagaacatgttaactgctaagcagtatgtctgcctgttccatggtctttacatttaagcactagtgacatcactggttttacaaagatgtatcactgtggagagaaaaaccaaccattcaatctttcaggtatgataagctgaggccagttttaggccatagacttaaccacccaggaacaattcctaccatccgatcaactgcattctgacttcgatattcctcaatgttacaaatgggcttcttcacctcttaatttgtattttactggaatttataagaagttctttagccagaggcttctttgaaaagacgaaaacttactgttccctccctaccaaaaaatacttgattatctacttataatattttgtccacatttaggtttcacatagtattttaatattattaaatgaaaaacaaatttatgctcttaaaatttcttcaattgcttgaaaataagttacaacatgcaatacgtgttctaaagccagctgtcatgccatggagcagtgtttggagatgcctgcacagggaagaaccgaggcctccccgcaccaattagcacccacttgccagtcatgagtgagccactttggaaatagatactccagccccatcaaggctgcagatgattataatctcatgaaagacctcaaaacagaaccatactgtaagctgtttccaaatttttgatgcaagaaactgaaatatcaagtgtttattattgtttgaagccaccaagttttgagaaatgttatatagcaatagataattacagagctcctcatagaatacttttaaatgcctaaaatatatacgaactaaagtaaaatgaggttataaaattattaaattttaatatatcaataaatgttcttcactattgcattaaataacaaaggtaatgacaagtctaatttcaacatattgtcaaatgtaaaccatattttgaaatgtcttcagtaactactgtgctttgaaaatatctgatttctgttggtgataaagtcgcaggccaaatactactgtgggtttttctggcatgctgataggttttttttttcctatatgcataactgaaagaaatactaaatttcatttacagattaaagaaaataaagatttaattttttcttcaaggacaccacgaattccaccaagaccccttggtggtccatggaccacaagctaagaacacctggtaggtgggtacagaacgatagcagaaattgtggtggaaaaggagaaagtaactcaagttccaatgccttcagtgaatcagtgggagggactagaagacctacagttgagaccaccaacaaggaggaaccaacaggttgtatactctgatggtttatgcttcaaagagagctggaagcttttgaagtaagaagccaccaggaaaataaagccatcaaagaacatccaggtttcaactacagcaaggaggaaagagaacattcaaagaagacgacagacttcgagttccaaagggcaaagtaggagggtttgggaagcctggaggacttgatagatatcagattagaagaatgaatggacctgaatagtgagagaagcaaaggggtgattactgatgatatgaattgattatgactcagctctgccgaaaggtgatttgaattgtgataactgtaatgaaaattaataaagacataaaccaaagcatgtggactacacctcctttattcatcttctctctgtctctactgtcgctagctcaggccacttctaacctgcctcctagccttctaacctgcctccatctcttcactgccctctccccctaccatgctatagcaattctctaccccaacatcattcaaccacctgaaaatgcaaatccagtcatgcccctcactcctgtggttaaactctttcaatagcccctcattactcaaaggatgacattcttggctcaaaggttcatcttgatctgaacatatttcctctctagacaatcttttcaccactccaccaccttacactgtatgatctagagataatgaacaacctagaatctcctaaacatgtacaggttgttccttgtgcctaaaacctacccacacctcataccccatccccttacctggctaatttcaactcaatcttcagctcccaacttaaactacagctcatgtaagagcccattttgattcctcaagactgagttagatgctcaaagacttagtgcttgcatcatataatatgtatacaattctttaaatgcctgtgaactaggctttaagtccttgagaacagatactgttattttattcactaaaccccctctgaacttaccacagttctaaacatgtagtggatgttatattaatatttgttaagtgaataaattaataattagcttcctatcttccaggcctggaacaccctagccattgcttcttgccatgctaaatttttctcaacaatattttaaataaaaaataattaacacagcatatgaagggagaatgccaggtgttatgccttttatatattcaataggaaaacccagactcttcctaacactgataatttagagtaggcccctacactaaaaacaaggataacttatgttatttaatatcatgatataaggtaataagaaaaatatccattcaaaaaggagcacacatatcattgaaaaaaaatttaacattcaagaaaccccaaagttctatctacccatctactcaaagtacaattctaattgcatatatttaaatattaataatatatacttgagaagtaatataaattagccctgtatatattacattttattttaaaaagcatagacctatattacccataaacaaaaagtcatgtgaagacatcaataatcgctttctacttgccaacctgacatgcttccactacgaatccatttcattggtatgccagaagtaaaattaataaggagtaaaaattacaccaactcctgccagcccagattccaacctgtccttcaaaactcagctgaaaagtcaccttcacatgaagtcttctaagatcaagtgaccttccagcccctatcatatcacactaaaactactgattgtctatacatccatttctctactgcacccagacgacagagaccttctttttccatatttgtatttctaaaagagtactaggcactcaacaaattattaatgaatgagtggacaaaacaatgaatatacaagtctgtacaccctactacatattagtatattcaactctgagagctcttgatcttattcccaagtttgtgctgatttgaggaggagctctctaaactatcctataaatatttaaagattctaagatagtacttaagtattactactgaaaatttaagtacaggaagtcctaattaactcattaatgggctaagaaaggcccacctgactaaatgaacagtttaagttatttaaaacagaacttgtttggatgtattttacattcagtcgccccaatccatgctggtatttctactttacacagaagagtataatatgaatatatagttttactgaaaaactgtggttgggcagatggtacatcacactttttatcactcattgttattaacttaccaaggaaaatataaaaagttaatgaaaatagaaagtaaattatagtacagagagccttatatcctactagaataataagataaaactatcttaaataattctaggttgagcctttatttttaaaagctactgacttatgttctattacttgactttaaagttaggcacaaattcaggtaattaaagtcattttcctttctttcataaatatgatgtataatttagcatatatcccacaagacacatcacatctaggtaggtacaggtaaacaaagctcagtcctattaggccgcattcatctttgagtgaagtctcacagaaatcacatcggaatgtactagagttgtctggtaacagttataccgaggaagaaggcccagagaacagttaggaggtgagagaagagtgaggtgaaagcttccactcactcactagaacctacatccacagcaggtgatttctgcagtggctctatgaccccattaccccgggaactttgaggagaacaaggaaagcctgtatctatatctgggcgcaggcagcagttgttctgagatatgtgaagtgctttctatacagagaaatttttccatgtcctttgtaattaaaagaatctcatatcctttaacagatgacctctcagtccaacacctcactattttttggggtggatttttttcagttttgtttacttgagatattcaaaatagttcatttctcatcttagaaaacatcttagatatagtatgtctttataattataatgattttctccggattaaggtcaatggctatgatacaatttctcttttccaattagaagtctcatatcgatggcatcaagggaaaagcggacaatattaagatacggtcttggtaacatggagaaaccccatcgctacaaaaaaatacaaaaattagccaagcaaggtggtgtatgtctgtagtcccagctacttgggggtctgagctggagcccaggaggttggggctacagtgagctgtgtttgcaccactgccctgggtgacaaagcgagaccctgtctcaaaaaaaaaaaggggaaagaatgagatatacttctagattttacatttggtgctctcagcggagaaaaggatagtacttaaatggcattataatgcttttgataaagatcatgttacttggagccaatctgccagagttttcctggctgccctctatgactctgaataagttacttaagctctctcttcccccagtttccccatctttaaagatgggaacagtaacagtgcttactcagaggtttggtgttacaattaaatgtgtttatatagtaaacatttggaacactctttagcacatagctaacaattacatagtccttactgttacttaacacaccgctcttctaattagcaaccacaattccctagttatgttgttttgttttgtttttttaagacaaggtttccctctgtcactcagactgcagtacagtggcacaatcatggctcactgtagcctcaaactccagggttcaagtgattctcctgcctcagtctcccaagtagctaggactaggactacaggttcacatctgcataccatcacacccagctaattttttttttttttttttttttttttggtagagacagggtctccctatcttgcccaggctaatctcgaagttctgggctcatgcagtcctcccacttcagcctcccaaacaaagtgccgtgattacagacatgagccactacactcagccccctaattatgtttttatactccctaagtaaattctccagcatcttatatctttgtattccctagaaggtttctgcacgctaatgagagatgcattatcaagttagagaggcagggtcctgtcatgaaggccttatctgccatgttagacttgacctatataaaacagttgcaattaagcagtttcaaacagcataaaacattatcagataggcaatgtagatagatcactctgatagctgtgtgggaaggtggcattttgggtagcaataggaagctgccagagtccagagaagaaaaaatgagaagactaggactgatagaagaaacgagagaagaagagattcaagaaataatcagaaagaaacattggaaaggtgaagctactttctaagagaatataaggaataaaacaagtttatgaggaaagtaaagggtttaacttagagcacacagagcttctagaatagatgagacatccattgaggttattcagtaggccaatgaattatttctcaattggaggaaaaggtcctaaacagagatatacatggttagttgaaaacttcagaggtgattacccaagtaaaacactacataccgagggaaagaatagtagaatcaggaaaaacaactgagaaaaaacaataatttaaggcaaaaaggaaaaattatgcaaccagatagataatgaaaagtcaaaggggtatgaaattgagaaaatttgatgtcacagaagtcaagaaatctttgttctccaaagaagcagcatatgattatatcaagtagagtaggtaaatccaataaatttccaagaactaaaaactaataaaaattatttgtgattttaaaacgtcatttattaaagataaagaagtcacaacaatcttatatatgcactttactgcaaagcttcaaaatacgtgaagcaaaaaccaatcgaacgggaaaaataaaatctaaaatcacagtgggagacttcgatacttctctcaataattgttagaacacacagaaaattaacaagaatacagaagatgtgaacagcactaccaaccattcagaatatacacgaatactgaccaagatagaccatgttctgggacataaagtaagacttaaaaaatcagaaaggacagaattcatgcaaactacaggtctctgaccacgagggaactaaattacaaatcagacacagtcaaatatcaggaaaacccctaaatatttggaagttaaataacatataccaaaataacccatgggtcaaagaaaataagaaatttaaaaatattcaattcaataaaattttgtgggatgcagctaaagcagatgtcagaggaaaatttatagcataaaaaatctaacatgttagcaaacaaaggtattaaatcaatgacttagagttctaccttaagaaatcagagaaaaaaataataaaacaaaagaaagtaaataataaaggtaaaacaaacaaaaacaaaagaactataaagaaaattagtgaaaacaaaagctagtttttcaaaagatcaataaaactggcaaacctctagccagactagtcacagagaaaaacacagaaaacacaaattatcaatatgaggattgcaaagggggtaattaatacagatcctgcattaaagggataagaaaatatcacaaacaactttatacccataaattcaacaacatagataaaatttaaaatataggtaaaaatttagatttaacaatataggtaaaatgtatgtccttgaaagacataaactaccaaggctcacttaggaaaaaatagattacttgaatagtcctatatctagtaacagacatttaaacaagaaaatgttaaataagcacataaaaaaaagttcaacattagtaattgtgggaaacaatttgtcagtttcttatcaagttaaagacacacttactatatgactcccacaaaaaacaaaaacatatacacaaaaaaaaacaatgctgtactcaaatgctcatagcaactgtactaataatagccgaaaactggaaacaacccaaactgctgaagttaaaccaattgtagtattaccaaacaatgagccagacacaaaggcaacacactttgtgactccatttatatgaaattctaaaaactgaactatagttcagaatgctgataagtgtttgtcaaaagccaggatgggagaagagaattgactgtaagcgggtacagagggaaccttttggggtgatggaaatatttcatatcacgactagtgcactcattattgtatatatttctcaaaattcatcagattatactcaatactggtacaatataatgcacgtaaattatattgtaagtaaatcatacctcaactttttttttaacttttaggttcagaggtacatgtgcaggtttgttatatagataaactcatgtcacataggtttgttgtacagattatttcagccaggtactggtcctagtactagtacttaatagatattttttctgatattctccctcctcccacccatcaccctcaagtatgccccagtgtctgtttttcccctctttgtgtccatgtgttctcatcatttagctcccacttacaagtgagaacatgcagtatttggttttctgttcctgtgttagtttgctaaggataatggcctccagctccatccatgttcctgcaaaggacatgatcttgttcttttttatggctgcatagtattgcatggtgtattagtaccatactttctttatccaatctgccattgatgggcatttagattgattccatgtctttgctattgtaaatagtgctgcaatgaccatacgtgtacatgtgtctttatggtagaaaattttatattcctttgggtatatacccagcaatgagattgctggatcatacctcattttttgaaagtgtgtattactaaacatagcactaaattataaatgcacggtttaccaagcatcttacttaatttgtcccttaaactatctctataccaaggctcaaaagctacataactaacacaaagtcacacagctagtaaatggcagaggtggcattctaacctggctttcctacatgcaactacatataataaagaatagacactaatgcaaagacctcatgacttcctctagtttctgtgcaggccaatgtttggttttctagctatagctgttaaccatttgtgggtcatgaaatcaatttagtggattcaattaccttttttttttttttaaggaatggagaggagtgaagaaaattagaaaggaatggaaataaaaagatcagaattcattttgcttagaaatgttaaatactggtttttaaacttttgtttcaactgagaagcagagagtttaggagtttatgcatgccaggctacaaaataaaatatatttcttaatgcagtatctagtcaaaaagatttgaaaaccattgctgcaggccaaacagtaaagcaggctgcagtcagatgaacaaagagatgaggatcatagaagtactatactgtagacaaatggttatgaaggacaggagagaaaacagcaagtcaaaaacaactcctatactccaaaaacactcagtggacacactgatggataatttagcattgtcacatccacattcaatgtcttccaacttaccttttcaaacctgtctcccctcactcccccctcctcccaacctttttgcctctatgaggaaaaccttcttcaaaacccaggtataagcaatggaagttataagctaaacatttattcacctttatttattaccctagcacctaagctgcactttatacaaagagaatgctcatatttatagaacaaacactgcttatagtctattaactctgcctagggaacccaacaatatagcaatcctttattcctttaacaagacagtgaaattcaattctgatagtaactcaagaaataaccttaaaacatgaagtacttttgcagacctttaacaaaacaacttaaagggataggtttttaacattaatgcttcccgtgatgttttaatgtttctaaaatactgttattcaaatgtatgactacagcacattgctattcttatatgcctctctcaagttctgaccaaaaaaaaggctattcacattaagaatttctacgttgaaagcatacatgcaatgtgtatgttgtaagggggcaaacttcaatcagaaaacatattgccagtacatatcaaagcatcattggcaaatgctgccctgagctctaacacaccagaaatagtttaaagagccctcaaaatatccagctaccctttcccttctcacaactctgcattgatctataacatataccctggaaggctcagctgcaaatgtgtcacaccacttctctgtctgtacatcaagaaatattttttaaaggggtaaaaacggacagaactgaatgcagcaggtcaacatacttaaacttaagaaactcaccaaaactatgagaaaggaagaaactgtataattagtcccaatttaaataagtgaacaatcaaataattgatttgccaaggtaacagagctaataagaggtaaaattctgtctttcaccaagaatcttctgattccaaatccaacaatgctctttctacactgtatcagtcaacaatgaataagaaagaatttactctttggtgtctcctgttgaagatagccatgcttattctcaaatctctacagcaacagatacagatgcctaaactaggctacctgcctgatccttccctggactaaattctgggcctacccaagagacaagctaaagcacaagatcagaagagaacagtgagagtgaggagacagtagttcagtcagcaagtccatgtgaagagggtcaatgaggaatccaggagagacagacgtgtacaattaagaagaaagcaggggcaaggcaatccaggcaagcggtcagaaagactgacagaaggtcctcattacagctcccttaccttgtgcaaaaaaggcaagactctgtctctgggaagcctgactagcgccaagccaggctgagatccaataccaggcaggttatcagaacagtgactctttcacttgttcaacaaaaaaatttattaaaatactcactatgtgccagaaagcatgctaggtactggaagtattcattacacatcgtccctgccttcaaaaggtttaaaccattgagaaaggcagataataaatgatgtattgttgaagatatgcactaggcattatggtaacaactcaaaagtttttaccttaccaaggccagttgcaaggataaagggagaggtgaggaatgggggaaggtcagagaaagaactaagaaagtcctcaatgaggaactcaattattaatataagatagagcaacatggcttctggaatggcatgccgaagccaccctatgactctagtttctaaaacttaaggtaaagatcgtgggttggcagtgtgcaaggactgtcatataatgaaaataagggcagtgtttgaaagagaaaaaaatgcaatgtccataaaatatgaataaacctcaaaaatgtcatcatacagaatactatccagcaataaaagtgaatgaggctggtgcagtggcccacatctacaatcccaaaacttttggaggccacggcagaaggatcacttgagcccaggagtttaaacccagcctgggcaacatagggagatcttgtctctccaaaaaattaaaaacttcaaaattagctaggtgaggtggtgcatgcctgtaatccccgctactcaggaggctgatgtgggaggattgcctgagcccaggaggtcaagactgcagtgagtcatgatcatgtcactgcacttcagcctggacaacagagcgagaccctgtctcaaaaaaaaaaaaaaaaaaaaaaaaacaaatgaagtactgatacatgcaacaatgtggatgaaccttgaacacattatggtaagcgaaataagtgaatcacgaaagaccacatacgatatgagtcaatttatatgaaatgtccagaacaggcaaatctatacagtcagaaagtagattggtggttgcctagaactgagggagttgagggaaaacagagagggattatttatgaacatgacgtttcttttaaggttgacgaaaatgttctaaaaatgactgtagtaatggttgtacaattcttctgaacagatcaaagctgttacaaatatatcattgtatatcataaaacttcaaacataaaaattgcagatggtttatcagccttaagaagccatttgcaagctgggttaagttagcacactaagtatatgagacttaaagcaatgtggaacaaaattcaagctataactgtatcacttgccagctgggcacacttgagcaagctacttaatctgtctgagcctcaatattgtcaactgtaaaataaagacatctaccttgcaaggtgagaaatctgtattgttaccaatttctatatgttagtatatgaaaatgtcatccagaaaattatatgtaaatatgcttttcttaggtactattcaaaggaataaaacataccaacattctaatacaatttttaagtcattcatgtcaagatctacgtttcattcgtctttgtattctgccttacccaggtgcataagacagtactttggatattagaagtactattttctaagtgcttactatggtctaggcattctccttcatgcttcatatatggtgaagtttaatgcaaagcctggtcaatggggggccatgctttttcctctataacacacttacatatttttggtgtcattgtttgtgttttgttgttgttcttcttgttattcctttactattaaccacaagttacatttaaaaatatatttctcagaaaaacttacttgactatgcaagaatctacaatggtgctataaagtgttactatgagaagccctattattttcaacataaaaaacgtagtaaggcatacccggttctctcatttttaagcaaaattttaaaaatatatatgcataatattttagtctgacttactttaattagcaactacatatttctgaaaagctgacatgtctttgctatttttacttcttttttgaagtgtgcaactcattcctaaagaatgagagttgatttgaatgattcaaagttgactaacaatttgtaattaaacaaatttttttaattaacatatccaccattcactttacaacttaaaaccaacaatttagtgtattttaccagttctgcctcttatttcagcactataagaatagtacgtttccaatatatgtgacttttagccatttcaaagatgttagcagagcacaccatcaacgttatatggttagttacaattcataacaaaggaaaagttgaggataatcttaccatatcatccgtcagtgtcctaatatttaaatgctgcaaattaaaaaaaagcaatcatattagtaatttataacagcttctttattttagttaatagggtacattcaaaattctacaatcctaacttgaatataattaaatttctgacagtccaataaaaacacattatatataatcgttttaatctctttctcaaaaagatggacaaaagttaccctgcgtgtgatagttccaaacacttactaaaatttttttactttgtaaaactcacaaactaaaaaattaactatggtacaataaatatattatcccaattaacagtattaattaccattaagtatattaacttagaacacaatgtatctgtctgagaatgagggcacatagaaaaaataaaatgaaaaagaacactggatataaaagattttaatgtgatgatttttcagaaaatttttcatattatagaacagtgaaactttaaatttaccattagtatgcagcataatagataatgaagtactttgctggcttaattaacttaaacaattctagtaacagagaagaatgtactaaaatgactatttgcatctttaacatcagtttgatttatcatgagtggtgacagtagacacttttcaatttcattgctagcttcaaggacccttttgctgatttccttgctagacaaacataagaccattctagagagtgaatagtttcctgcaaaatacaattcaaaagaaaaaaataattatttagagaaaaaacacagaaatctaagttttataagtcccagtgtcgggaaagatattgtattcaagtaactggaatcaattaccaattctcctttctcttattcactggagcattcaatttttaaaggggcagggaaagggtcaaacacattttctaaataggaaacaaggtctactcttttataaggacagatgttaataaccattatctaacagactaagtggtacacagttaaattcaacatttacttaatagaatgaaatttatcattcatgtttgtatactcaagtacaccttcatgctcatgaatctacctcagtgatgatccagattaaaaatctgtacaatgtaaatcaccatcccagattctcttctccctttctttcaccaagatgttccttcttctagtgcaaaggaaagaaggtaacttgtatctaaaatgaattttgtgtataccaaagaaaatgtagccaaatgaaagaccattagccacaccactaggctccagattaaactgccttgttgaattagaatcacctactttgacttgggaataaggaagtaataatagtggattaactaagggttagtatctaataccaggctatagaatttgcttttttatcaatactatcttcagcctttgaaattaacaagtacgcacggtggtccttaaaagtggttgggatcctgagcgggatgtaaagtatgtaaggaacttagggccacagtgtcaccccagagaccattactaaaattaaacccaaacgtagagggctcttgagtttgcagagaaaggagctggggcaatgcctgtgtgaggcgcccttcctctaacagcctgttgtatgtgtgccttcctgccagtagaggcttccagcctattgcatttggttaaccacatttcactcttgttattccacaatcagaggtatcactccaatcacatctcatttcactctcaaaagggttcatttcaagttcctgtgaaaaagaaaaaaaaaagtggcaggtaatgaacttctggcacaatggcatgccaagtggcctaatgcttaaaaagtaaagccaaagaaataaactataaagctgaaatcctatttaggatggtatgccacaataaagagaaaaacatctacttaaacaaataaaatattcccaaaaccagcttgaattgcctcaggaaaatgccataaaagtgatattttaaaaagtaagagtaaaagacaataaaaatagataaataattttaaaataaagacgactagggtccaggcaagatttatgatctaaaaactacataaaagatacagaaagtaaaaggaaaataaaactagacaggaaaataggaaatgtaagttacatgatgcaaaatccagttgtaaacattcaagagaaacacttatatactgtcaaaggtctaaaattagaccatctttttaaaatttcagttgggctcacaacgttcaggaaaaagaacagccactcttatgtaaaaacaaggcaacccagggatccatttttggtcatggttttcttttttttttttttttaatatatacattctgaaactatctcattgagggtatagctttttaaaagatttaatttcctaaaggcttgatctgttttcaaactatataggtatgtacataagcccagttataacctatgttattatatttcccaaagaacatgtgatgaatcacaacagaattaagatgcaggtgtatcctgcatggagaagaaaactcaaagggatgtagatgtggagagtataacagagtctgagagaaaagaaggtcaaattcatcattccttctcttccagagaacacttacctatcaattctcaccatcagcaagagaagtcaatagggcaggaaatcacagcaaattcaagagtccagacgggactggagaaactcactaacagagtaaggagctggaaaactgatctgagaattgtgtttctttctacaccaaaacaataaagtcagaataggtttcatttcaagatttagcttgctgaagaatagagattacatagttatgtacacacatgcaatcttaaaccactaaagataggctagcattaaaaatctaaataaatctaagcactagtaatttcccttaaaaactggaatgtctcatcatagtttactttaaacgtgaattaaagaaaaaataaacactaaatacttagtgaaaaaatgtaaacactatatcaagtggcaatcttttgtaggatgtctgaatgttaatactaaattcaagtttatcattgaaagtttacatgatctcaaggtcctgcctgtttggcttatacacataaaatagggactatccatgaagtagaaattgccaagaagagggagaaaggaagaaaatgactaactaaatcctcagataattctatggggttttagccttacttttgtaaatacaaaactataagggtaatatccttaattaaaattagaaaaaactttgtaacacaaaaatattgattttatggtggtacttgaggtactgtttaaaatgaagtacctctgttttatagccaccagcaatgctctttactgtcttctagttcaggaaaatagttaactgcaaacatcaatccagttcatgagtagccaccgtggacatctactccaaaaaggaaatagaaacataaaaccgactattaaatggaagcaactaggaaacacctttaaaaataataacctgatagcaaatttttagggttatatttaccaaaaaaaaaaaaaaaaaaaagttagaagcatacagttttagacattaaaactttcatatctaaatgtgactttgtgacctttacatatattacctacctggcctatgattctagaggtgttattaatgttttatggcactgaaatcaaataaaactcatgattttaaattataaacaattctgccgggcgcggcggctcacgcctgtaatcccagcactttgggaggcagaggcgggcggatcacgaggtcaggagatcgagaccatcctggctaacacagtgaaaccccgtctctactaaaaatacaaaaaaaaaaattagccgggcgtggtggcgggtgcctgcagtcccagctactcgggaggctgagacaggagaatggcgtgaacccgggaggcggagcttgcagtgagccgagattgtgccactgcactccagcctgggcgacagagcgagactccgtctcaaaaaaaaaaaaaataataataaataaccgttctgtccacaagactactggttattggttaaggtgtgatattaaagaatatgagggctcttttcctaagctaaaaactcatccttcttcctctggtcctatgtttctcaaatactaattctattttctccctaaaaagtaaggagaaccacatacagatgggtaacaatgttttctgttaatgacagttcctaggatgaatggtcaagagggtcactctggaattgaaagagaaaaaaagcctttatagatttttcttcaaaagaacataggagtcggggggaaaaaagtagaaacacagaacatcggtctctatattcccatttaagcaatgcatcaaaacttttattgaagatagtacatgctgtcaaaaaatggatttagagctttcagagaactgtgctaaatgctgtgaatatcaagaggcatgtgaaatagtttccccactaacttagtttacaagtaacaaagacagataaattgtagtacacaaagcaatatacaaacccaggaggtccacacacagtgaaaaagatgccaagctgtagcccaagacttttcgcaaattttatgttttctttcattggttagcatatctgaactagcaggccaatggagcaaaggatctgtccattgatatcattaggaacatgacagccaccatcagattcaagccagtaggcttgcatcaatttattattatcagaaccaaatatgtggtagcatttttaaataatctttggctgacacagtttaattccattaaaattgacttttttttttttttttttttagacacagtcttgctcggtcacccaggctggagtgcagcagtgcacttgatctcaggttcaagtgatgctcctgcctcagcctctcgagtagctgggaccacaggcgtgcaccaccatgcccggctaatttttgtatttttagtggagacagggtttcgccatgttggccagactagtctcgaaatcctgacctcaggtgatcctcccacctcggcctcccaaagtgctgggattaaaggagtgagccaccacgcctggccaaaaatttacgtcatttaagtgggttatgagggattaccaacatgaggaaaacttgtaagattaaagactcagacacaattttcataagctagatcctccggaccagctggtttttccaggtttttgtttgtttggcgtgcacaagaatcacaccaagactttctctgaaaagctagattagagggcctcagtctaccaatattcttattcagtaagtctaaggtgggacctgggaacccacatgtttaagaagtcatgcctgtaatgatgtggcagcatgcccaggaccacgtgagaaaccctactccatactccaccactatcagccattaaacattccctcagcctgcacacatatgaatttctcatcatgtagctcactttaaaaactggacatacctgaaacaagccacatgaagggtatagataagaagtacaagagtatttcaaagaagtgaaaacagagagctgataaagttgggacaggccttactgccatgaagtgaaaggtaccaattagcactgttttaagataattcaacaatctctggtatgtatgatgaattaccaattgcatcatttatttaaatgcttagtctaaggtacaaatcattcagtctcataaacataaacttagtacctaagtattaaagattgttcattgtatcagactatgacatgataccatttgcttgacaaaatgaataaatcacaggttactaacaggaaggaaggagaaggagaaggagaaggagaagaaggggaagagggaagagggaagagggaagagggaagaggggaggggaggggaggatatcttaaagaaaaaaggaaaggattagtcttctcttaatcatcttctcttaatcataatctatggctgataataggttgagatgttgctcacatttttgttttgaagtccagattattcctttccaacaataatgtatgaatatgtacttcaatctgataacatttctagcccacacacctgtgtttatcttaacgtcaacaccaattataaagactatgaaaatttaaagtaatattcctaccagccatgactctcgacacacctacagagtctatggatcatctccctggcaactacacaacacacatagatgtgaaaatattattcttcaagggctccagatttaacatctaagaaaggtccaaaaataatactgaagctttcatagcactgaggacaagagtagagctggctctttgatactacaaagaaaaacttttaagttgacatgttttttcagtccaaggtggaaaaaagtgaaaggggagatgttaggaacaggtgagaattaggaaaagctctccagcctcttttaatctgctcatttattcaaaactgcaattctgccaacctcagaaagacaaacataccatgtattactcactatccaaagcttctctactgtcatgcactcaagtatccagacctccctgcccctcaattcctccatcgtgaaaggagagccaacgagagatcagcgttaaggagaaggcatcattcaagtgtccacagcagtgaaaagatgcatttctctgagaacacaaggtttaaggaggcaacatacctgctaggaaagaactgcctctgtagaaaaaaacaattatcatattgtggcttgggactctgacctagattgcaccccacagaggctaacctaacaagtcatttttcattctaacataactccaatattctttttccttgaatgaactcattcaatgttggggtaaaataaaaggaaaaatataatggctaatttagtaacacagcttttgtacatattttaagatgcctcttcgtctatttcagttcttttcacctatactaccagatgaaaaactcttttgcaacatgtccagggaaaagcaaatcgaatctctgaaccactttacaagtaggttcagttctaggttatgggaatccaagacctttttcattgtctggagaaggctgaaaagcatttacagtatttgctatacagagaattagagatcccagaactcccagagtcaccttgaagcttatcgcaactactaaattacttctgagagtggcttagcatcctagacatcttgtccacaacacaaatttagattggatgttcctgagactgacagagcatcacccattctttcacatatatttgagaaagattttgtttatatttcagcatcaccataaaggaaatttggttaaaccattttaggaaacaatttggtaaaacaaatcccatgttcacactttaacctaataattctacttctagaatccatacttgggaattaagaaatacaatcaaaagtttatatacaaatatgtatcactacagcattactttaaatagctagaactgtaatcagcctgagatttccccaaacataggaaagattaaataaatcacagtcctaccaatatgaactataatgacatggaaaaatgcttacaatacaatggtacatgaaaaaaagtgcatttaaaattgcatatgtaacataattccaacttcattaatatacatatatatggaaaaaataaaacaggaatcataggtaattttacacatctggattatgggatttgtgggtttttttcatatcttcatgtattttcccagttgtctcaataagcatatttacttttaatacagaaagtattttttaagttactatggataatacttttcagattgagcagaaaatacagattgttccttttcaaataaaaatgtatgtattagtaaaagaaaaaatgaaaatctaaaaaacatctaataaatatgtgcacagactttttaataggctagttttttaatgcatattttcaagtatgtcagaatatattaagcacattattcgtctgttttctaattcacatatataaattatccaatctcaaaaagctccttggttctgtgaattattgatgttgtcacctgctacagacttaattccaagaaaaatatacgaatcactacatcacaagcacaaatccttttgacacaaattcaatttctgtggcaacaataatatattgactttgctttatttttctactttatgacacttattaatggcagagttaaaagaaatctatcatttttctttattgtaaatgtaaatgatatcatgccatcttgagaaagttagggtaaataccacttactagataattccttaatgtaaataaggtcatgatgccaaaatataagaaataaaagataaagattttaagcaagacctagtctcataattctaattttttctactacacaattaggccaacatgtgtgagacacatcattaaatatgaagacccagtctctccccttacaagcttgcaaccaaaagaacaagataaaccaataaccaaaatgcttcataataaggtattcaatggtgattggaagaaaagcggagtctccacctgctaatcatatatgcttaaatgcatgctaattaacaggcaagcattatagcaatgatctaagactaaaggcaaataaaattttagccatgattcaggtaaaacttggaatgtagaatttgttcttctaacagaatgaaagattcctaaaacattcattcatgcaacaactgttaattaaatattgctatattcttgacaagggagagatcaataaataaaacaaagatttttgccctaaaagaacttatctttattggggaaacagacaataagcacaataagtaaattacttatttaagatgttagaaggtgatgaatgctctgataaaaataaaaagtagcataagccaagagggtttgcaggttgcaattttaaacatggggaattgaggtaggcataggcctcattgacaaagtggtgtttgagcagagttgccagtgggctaaggtgtcatctatatggatgggcaggggagtgtttgcaatagaaaaaacagccataacaaggctgtcaggaggagtatgcctgatgttcaagaaacaagggagcttgttggctccaacaggacaaaatgaagtcagtgagagggaaggaggaggcagatcagtcccagaccatttcaaagacgtgggcttttacttttctaactgaatagtcacaaatattttgtaagtatacaaatataaataaccaacttacacagtaaataataatcagatcagcatattcagcatattatacaaattactgaaggtagggaggaaggtctgtactcaaataatcattatttacttgagggccctttaagtggcttagttatgcttccaggagtcatttaccagaaggtattagaaatactctcaaaacactgtaaagccaataaaggcaatttttggaaaaactcagttaattctatcaattatttttttaatatggaattagtctagggggtagagggaccagtttagcatgtctagagaaaaaacagtaagaaaaacagtatttacaacaatttaaacataactctgaggacccctcggaagtttgagcgccaaccctaaggagtccccccaagaggtctacatgcagatggtaatgtgctccacacgtgtgcgagtcccagcaacagggacccttgtagacagcccagcaccagccatggttgcccctcctccagctcctaccatcagggactctttcccttcctgcagttaataatctctgatttacctcagcatctccaatatgcccttttcctttcttttttattttttattattttttttagagacagggtcttgctgtgtcgcccaagctggaatgcaatggagggatcatagctcactgcagtctcgaactactgagctcaagcgatcagcttcccaagtagctgggattacaagagcacaccaccatgccccacattttttttttctttttttttttatagacggcggtcccactatgttgcccagactggtcttaaactcctagcctcaagtgatccttctgcctcagccttccaaaatgctgggattacagtaaggtgtgagtccacctcatccggccagcctttctcttttaatactttcctaaataatcctcaccttaaaccaacctaccttggtttctgtttatttctgggccttgaccaagacactaccgcagtcctctccctctcaatacctggctcacctttcaaatgctgcctgattcaggaaggttctctaagcttgcccacatcaagcgtgccttcctagcacttttacatcctgccttgcactgtggcacaatagagcagtactgagcagaggtgaacagcctcggctctgggataagactcacctggatcagaatccagctctgataccaatcatctgtgtgatcttgagcacttaaactctctgagcctgaatttcttaactgtactatgaggcaaacaagcatcttccccataggcttggtagaagacttatagaaaagaccatggtacacaaaatactacacctgaggttcagaaactttgaccaatgttattctgcttccttcacagtaagatccatataggcatcacctgggttcagctcactcattctcaaggatactcccaatagtcttctcctcctctagggccccataaccagtctgtaatccatctaaatccattttaaatgtgtactgcctctcctgtgggcttgatttttgtcatggtcaatttaccagcagctctgttttgctgggtgtcagttatgttgggctgccctctggggcctttcacatgctgtcatatttctttggggctcaaatatgggggttgaaaaatctatgcagtggcagtttcctaatgccatccccagagccagcatgttgccagggcctcaggagactcacagtcagatggacgaatcagatgtgaggtaaacagattaagtaggtactgcagataaaaatttagagtaagggtggatcaaccttcattattatggagaaatgatctcatttccttcttcccacagcccttttgtttacaattcccttgggtcaccgataatggtttgtcttgcagtttgtgtttatacctccttttctgtttgtatgtcgcaggtactatgttcccctcaactttgaatccccagccctaccatggtgcagggaacattttaggcagtggttatcaacctgactacatatgagaatcacctgaaagcttgttttcttttcccaatacggatgcctatgtaatatcccagcccaaatgaatcaatacccaaagatggagcctgccatggataattttaaaggtccccaggtaactctaatgtgcaacctggaaacaaaactactaaaactaggcaaactattttagactcagtctttcagcaccaagactgtcatcaagaaatctccaaagatccccacatgtaaacaaggtagacacctgtgggtgtatctgcctcctgcacactgtctcttctctgagaatgcctatgccatagaggtaggcccaccagtcttcactgttccttgtaagccagccctagccgcagctaaacacaaggcagaatataaacccaagcagagccaatcaaatctccattttcccagaattctagaattggaattcagatatgaaaatcaggctctactcttgcacggaccaaggacatgtatgtctatctggaattatgaggttctaggcttggctgtgtgaagatcaaagcagaggaagccacacaatgcagagaatcaacagtggagctatgcctagtgagaagcaaagagacactggatggcctgagagggaaagagactgagaaaagctgtcagcttttagttcctggttccagtcctttgtgacggccagcttgattagaggtgctactcttgtgtatctttacaattcctcctttcaggattacagtagatattgtatagggatctgttcctttagaccaaatgggcctttaactgagacagaacccaagattgctaaatgggtccctaggtacccatatgatacagcccaccttatcactactactacaccttactggacactttgcgattactagtatacccagcaaccctaaaaactcgctattatccccatcttagagaacaggaaattgaacagcacagaagtgacttataagggttggtgagtacctaggctgggaatgagtcaaaaatccagcctcactctccttcctttccctcagtccccagaactatgatgggacagccagctgctgaagcagtttctgaattatttatggagcaaagaattcaaaaatgaaatcttaacaagaaagatgagcataattccaattggatgattactaaatgataacaacaacactgactacaaaaccacaccttaaaaccaggcgcagtggctcacgcctgtaatcccagcagggaggctgaggcgggtggatcacaaggtcaggagatcgagaccatcctggctaacacagtgaaaccccgtctctactaaaaaaaatacaaaaaattagctgggcgtggtggcgggcacctgtagtcccagctacttgggaggctgaggcaggagaatgacgtgaactcagaggcggagcttgcagtgagctgagatcgtgccactgcactccagcctgggtgacagagcgagactccgtctcaaaaaacaaaacctcaaagataaatgggcatggaggggggttgcaatttctgtcaattgactaacactaataagaatacatggtttgctagggtgtttcctcctttttttttttaagttgctctcaaatgtgtaatagaaatgaaaagcttttttatttctcatttatagatttttaaagctggggtatataccacaaaccttataaaccatacactcccaattcagactgaaacataagccaaaattatccacattccaacatgtcactaaaaaatgcttgtcaggaattataatacaacagctaaagaaaatttaatttcttaaattattgataaagtttgaacttattctaaataactgaattaccattaagttttcttgtataatttaatactacttattacaccctctaagttgttttatctcttaaaaggaatcaaaaagatgattacatatttataaaatgagcatctgaaaaatgaagagcacaattccagtttttacatgcagttccagtactacgcataagatgtaggttaccttttacatttctttcagaaatattaaccaaacaggatatagttactgcacatctaagttaccaggccaccaggtgcaggctgggtcataaagacctataaaatatggtacctgccctgaagaagtttacaatccaataagttctagaggaaaaagaaataagctgggtcatttattttcccttcttggtgattcaaaaaaacaatataacattagtaactgcctgccagagctaaacatactgaaaaacacagattcatctccttaatgctttcctttgcacttgtcatccaaagcaatgtggggaatttggagagagaaattctagaatgggatttgatacagagcggcccaatactgtacctaatttgcactgtgccatatgcaatacagtgaaatcctaacacattacagtctatattgcagtctggttatgaacacaccaatttctgtagtccagccacaagctcaagcaactgcagcctaactgtccttggaaatcctccaacaatgccaaaggagacttcagcaatgatttaagcatatttgtataggacttttaaaagtacaatagttttaggttgattatcgcaccattcaaacacactaataaaaaaaggcaacaaggtttgcaggaagtcagcagctgatagccacaggtaagggaaggcacccattgatcctaataatctagtgaaaattactaaggactgcagatctcacaaggatgtgaagataattctcacatgcctgtttctgtcatcactgatgttgtttcactcgtaaacttattgagggtagctccataggctataaaactgcatcatctttgccagaataaaatgtccatgttatctataagagttaaatcacgttactggaaggtagtctataagaaacacctgactcacaggtgaagcctccaaggcccataggtagtccctttaaacttgaatgtaggcaaatgtctgtcagctgaagaactaggaaaaaaaatgctgccaagaataccataggaaaattctcagcatgtgtcttcaacttgtgcaaattcctatttacagagaaaaggtcatttggaaaatatagccatttttggaagactgagcagccaaggttcttaagtataggagattgggacaaaacaaaaaaaaggtaaatttgttcatcaatctacttggtacatgtttggaactagagactcaaatagggaaaatttgctcttgggcctccccttcccctctatcagataagtaaggctaacagaaacttcaatctgtaaggtacagtacagtgagattagtgctataactgacactgatctaagcattccagaagatctgcttacagataccagggaacacctcagggtccagatttgcttcaagcatgcacagaggacactggaatggaccaaaccagcacagagcaaaagctttctagacaggaggtctagcttgtaaaaatacattgcaatcatgcagggacctacaagtaaattgtatgaataggaactggaatttcaggtggaagttgagggatccaatctagaaatgtgggcaatgacaaaatttaaaggacaagatcatgctacttggcctttaagttgtggatgatgcaggagagaaactgaagggttttaagcaggttccataatcacacttgggttccaaagaaaactattgtagcagcaacatggtggataaaacagagtagacccaagaacgagagccaaggaaatcagttaggaagctattgcaatctattgcaataacccagcagagagatggaaggtaagatagatgaggtcagggacagtaggagaagagaagaggcaagtgctataagtacccaggaagcataatcaaggttactggataaccaatgcatatggaagttaaagatcaagaagttgaaaataaatccaaggataaaatgttgacactgactaagagaatacaaaagaaagaagtttatgagaaagcagataaattcgagttgagatacagtgagtttgaggtacctctaagccatccatgtaaaataaggttgaatattttggacaaaagctcaaaagaccatcctaaaataaagatggagttttaagaagtcatcagcttctaaatctgagctgtccaatatgctagccattagccacatatggctatttaaacacaacttaattcaaattacacaaattaaaaattcagctctttggtagcagtagccacattcaagtgctcaaaagccacatatagctagtgactatcaaattggacatggcaggacacaacatttccatcatttcagaaagcactaatctaagtggtagtaaaagctaaagaaatggatgagttcacactagaagcacgtataaagtaaaaagagaaaatcaaagagattacttggaaagactcattttaaaggatagggaaaggaataaccaaagatcagaagagaagaacatgttagaccatggtttcaaggggggcaaggtttgtacaaatacaatgaagaagtcatatagggtgaggcttaagacaaaaatcagcactgggtttggcagttgatctgcctgggcaacagagcaagaccctgactcaaaaaaaagcccaagttaactccacagcctgagttcttaaagattatgctacatgaactccccagcaacactgtagtatgtgttgattcacacctctctttccccataccagactgaatataaacctcttgaaatcaaggaccaaattgcatctacccgtgtgctatgctcagtataactggcattcaaaaatttaccgaataaatgaaaacaagtaattcacagaaagtggctaaaaaggaaggaagcagagcatggtattcagagagacaaagggtcaagggaaagttgaggaaaggggttgtttggttttccttctgctttttctttcacaatggtaaacatttcagcaccattacaggatggagcgtgtaaaaagcaaaaccttcctgacagaatgtggatgggccaaaaacagcagtaaagagattaacctcaaataggaaaatatattccttgtgtggatattggaggagaaacaatgaagaatggtcgcagatatagacaattacagcaagctctaggaaaactttctctgaaaaaggtatcaaggggcatgctaagagtcaggagtaatcattcctaagatcttaagcgaatgctgtggtatgttcccatgtgggaaaaaagtgggtgcttgacatacacacagaatatcattggaaggatacaaaagagctaggtgcagtggctcacatctacaatcccagcactttaagaggctgaggtagaagaactactttagcccaagagttcaagacaagccagggcaacacgatgagaccctgtctctataaaatataaataaataaattagccaagcggtgcagcgtgcctgtagtcccagctactccagaagctgaggtgggaggatcacatgagcccaagaggtgaaggctgcagtgagccatgattgtaccactgcacgccagcctgggtgacagagtgagacactgtctcaaaaaaaaaaaaaaaaaaagatataaaagaaaataataagctaaccagcagcccttggggctgctctgcctatggagtagccatcttttgtttctttacttctctgatactttctttcatgttaaaaaagaaaaaataataaatgtcatcatggcaggtggtggggagggggaccttaattggtggtctaggatggaagggaggcttagggaatttcccctttgtactcctacattgttggactttttaagaagtacagatgttgtttttcagtttatttattttttgagacaggatcccgctctgtttcccagactggagtgcagtgacacaatcatggctcactgcaaccacagctttcgaggttcaagcaatcctcccacctcagccttccaagcagctgggacttcagaaatgcaccaccacgccaggctaacgtttttgtatttttttgtacagacggggtttcaccatgttgcccaggctggtcgtgaattcctggactcaagcaatccacctgctttggcctcacaaagtgctgggattatagacatgagccaccgcgcctggccgctttttcaattaaaaaaaactatttgggacaaaaaagaatcaggccaatagatgagataaagaagtgataggtttagcataaatgctgtgagaaattgaaaaggagatgaccaaagagctagtgaaaagtcaggacccatcatgccctattcccagttaatctctctgtgtctcaaccccctcatgtgcaaaataacagtagggagagtgcccatttcaaagtactgtgtgagggataagtgattaaaatagtgcccagcccgttgtatgagctgaacaaatgcggttattgtgatgatgattgttatctagcagcactgaggacacacagatacccagtgtctaagggcatcagttcacaaagctgggagtggtttccaccaggatgcaggaacccagttcagccacagaagcctgccaggttgctccaggcttggagatctgaggcaactgaacaaggaggccaaaggttctattatttattgatattctaccttatgtgaggtgtgaggaagtgaggagtttgaaggcatcccagttcaaagggagctccatggttacttttgtggagtgtgggtttagtgtggagcaaatgttgacagcaggaggcagacagagaaagagaggcaatgtacagaggctgtagtaggtctacatgaaacagaaaggaagggaatatatccaggcaccaaacaaacctctggtgtgtgtcccactgcaatgaatggctgagtccctggacacaataccagtgtcccccaggaaaaaaaaaaaaaaaagctatgaggataaaggaagtaggaagcaggaagaagaggttaaaatactgtcaataactgagaacttaacactatagtgatgaggtctcccctattaataatagttgtcacatattaattgtgctgtgcctaagctatcgtaacatgtgttaactcaactaatcctcacaacaatctataagcaaacagactaattacttccattttatagaagggaaaacagaggcacaaaggttgataatttgcccaaggatatacagacacgtttgagtctctctcaagtctttttatcacagtttaagggtgggacttcagagccacattgccaggcccaagttcttcaataacccacatatgtttctggtagtctttacatacccttgcccaccaccactaggatcttttataaaaagaaatgagtaattattaataacatttaaacaaattcatcatgaatgggttaatgaaccaggcaatataaagttacaagagtactttgttttgattttcaattagccaaacattcagattcctactgtaagcacaagtctataccaggcaccacacagaaagtgacttccaaaagcttacaaacacatgtataaagtaactaaaagcaggttcaatataacataacaataagagcaaaattataccctcaaaagagactgagtggagttagaacatggttttaattggagaccgtcaccttttataaagaagtgaaatagtcatattgaatttctcaatgcagattatatgcactccatttttcatgttcatttcccaggctgtcaattttttcattaaaaaagaattgtaattgtcattatgcaaggaattcaatcaaaggttttaataaacaaaaacagtttaattctatagtaaagtccataattaatgtcaccaatttgcaaatcttttacttaaaaactgaatgttacaaagtttcattttatgacacccaaataaacagccaacctcggaaaaaaatgcagcaattacgggataaactctctgtatcttgggaagatacttcataataaaattaactaaataaatgcagcattatggatctcacaattaatctactcagggcttttactaagggcttcaagaaattctacaccataactcctttgacagaactatgactgaacaggtattcagtcttctttaattcaagagggtgtgtacttagaccacagctacttggatatatcccacatccctcagcacacagaatgacctcacacttggtacattaattcatagtctcccccttcctttccagtatttaagatctgtcatgatcctcaaagatggagagatcagaaagctactgagtattaattccattcacagatttacttttagggaaagatatatatatatatatataaattggaaccctaaaaaaatcaaaattgaatttaaaaaaatcaaaattgaattaaaaaaaaaagccctgtaaacccaggaaatgaagagtaaagattagaaggagataaagataagaagggagaaaatgaacatttcaatggaatttatgatatttaatgttttaagcttattagtgagtatacagtgttttacacctcttttgtatgatacatacatgataaaatatatttttttaaagattgcaagtttcttatttaaccaaaaaaactattagaagcaaactgttttgaaacacattgtatacatccttcactactgatacttactaatcacttttacctcatcactaaacaaaggactaaggtgaaaaacatttgcctggttcaggtacacatctaatttcttaactcaagtcatctctgggtaccccaaactgtggtctacagaggccttccacaaattctacttaagtcttatgttttttcaagattatcttaaacattagaactaaagtaagcatattctggacattgtgaatgacccactctataaccatgttctctcaggaacttttggttttacttttgtaaatacttttgtatttactaccaatatggttctcaatgagggccaagcaacatcatgacacaatagattttcacaagctcttccacttaggaagagttcagttccaaatggctatttataattccaaaatcacattattctggaaactatgcacccacaggtatggaaaattagatttcaagagaaaaatgaatatagaagctggaagtataagagtttttattttttctgctgcttcaacagttttataacatttactaaaaaatgtttatatatggctattttctttttaaaaacaggtttataacagttcactacttcatctacatcctcaagccaacacctatgaaaaagataatggtgtccgatgacaggcctctgctaacagtgtaaggctatctgtgaactcctcagtctacacatatcttcctcagcctctgggattccatttccacccaagaattaaattgatagaaagaaaaacagcaaaatatacacatatttttccactattaaatccaataatgatgacttaatttcagcaaaacatcatcaatcgcattaaattaatgttgctgttaatttgaattttatgggttttatagttttgttttggattgtagatgtaaatctgttttagttttatagctgtaaaaagtgataggcataaagagttacacttagttttatatctgtacatatattagtaacattatttttattatcattcaagtccatattggagtatcacaagaattttttttcctaagtttgaagttgtttcctttatacgtttttttgtaagttacatttgtaccccaagtttcatcatcctattatccccactttagacataaagaacaggcccctaagaaagcttcagaaacttgctctgaccattcagtcatcagatcagaactctgcatcaatccaaatgttacctggtatgccaggataagaactaagaacagaatggctctgcctccagcacaccaagaggaaatagcctggttcaattaagttttccaagattagaaagcttttcaaatatccaatgtattcctaatgccctaaagtgtaggcaaaaattgtactattattactgttactactaatgataacaaaaacaacaatcctataaatggcaaatatttccatagaggttacaatgagccaggtattctaggcccaaaacataacttttaatcttcatgacaaccccatgttacacatgagaaaggggaggcacagagaacggttaagtaattgctcagttcacacagctaataagtgatattgctgggattcaacccctgagagtggttcaagtcactgctcataaatgttactcataacgcttcttctacaaaaaactgtaagaaaagatagcagtgggtcttttgaagaataaaatctatggcaagcatttccaaatagatttcactaagtaactagtaacatgaatgtttcaggaccaaagcttatttaaactcttaaattctcccctaagttaataaagactattcaatttgctatttgagaaaaattactcccaatggtaaggtatttcaatgccatcctgctgctactgaaagaaaagttacctttgtagatcctgttcaaagaaagcccatgctttgatccttaatatcccatgaagtaaaaggttatgcttaatctatattttatagatctaaaagtcaaattagtttctgagataaacaagcaagagtgtaaggataagcatattctttagcattcatttgattcctagtttagaggatactatgtgctaagttaaagacaattacattagtgtaatacgtagcagttttttcctgtattattctgcagcataaacaagttagacacatgttaatttacattctatataaaaagccaattttaaatccaatttataaggcaataaatatataaagattctaggacacagcaataaagttacgccataaagtagagttaattcaagacaacaataataaaagcatgacaaattttagcattccaccaactgcacaaaggtgtttcaggtaacatctgttcagaagcaattgctacaagatagactagatgagatgcaaggtttcaccatgtaataaatgtatgtcagtttgcttgcttcataattaaagacatgagtctttgaaaaaagcaattaagccctgttctaaatctgagacaatcatccctatctctacccccacccctttttaccgtcaaagaaaagacccagagtggtccaggagtattaaatgccatatgttatctactttcagcaactaaatgtatcccccaaaaagccacttaatatatattgtttcttttgataaatcatttatttaaaaaaatttctgggtttttctgttttattaagaaggatagaaaggaaagaatggctgggaaaattcagagcaatttcttagaacagcagcctgaataaaatgattttacctccttctgaagcttacaatgcctggtgtgtgttaggtagaattctgacacgaataaaatttaggtgcctaaagctttcaactaaaaacagtatctcaattcttgacagtttaaccctaggacaactgagagcatcacttaagctgagaactcaatgaaggaacaagttcaaaaaatcaaaaagagcatttagatatcacctccatcttttcccagcttcctagaaactataaatacagagtagacaaaacatgaatggaggttttggttgttattccagtggtggtttatttttctattgtaatttggttatcgtctgtcctcccaaattacaaacaaaccctctgaaataaagtgaaggcagagatttaaatgaatctgatggtcctccttgtaactatacctagcttcatttcctatggcaggtgtaacacattaccacaaactggcagcttaaaacaacagaaattcattctctcagttctggaggcctgaagtcccaaatcagtttcactgtgccaaaatgaaggcaggctgctctccttctagaagctctaggggagtagccttccttgactcttccagcttcagatggctgcattaccaatctctgcctctgcagtcacaacactctctcctcttctgtggtcaaataacaatacatgtgtttgcatttaggggccactgtgataatccagaataatctcattttaaaatccttaatcatctgtgtaaagtcctttaaaaaagaaaacaggagaaaaggcatacaaaggtattatgtgcaagtgtggcaagtgtggagtcatacaaagtatgaaactcaaacaagggccagatggctaaatcttaaataccctcttcatagggaagagggaagtggggtatgtaaggcaatttacaggatgagtaaataatctttaggggggatgaatgggcccaaagaagagatgaaagtctgagacaaagtttatctgggcttggtgtggtgtcaactccaatcttccttcagtatacatctatttgacttgagatgtctgggaaagagattcacaagttgaatatcttctggaggatacaacctttaggtagataggggaacttcagagaagaccctttcttgcatttctggctccccaggttctctcgatttgaagtccaaagtggcatatttgggggtataattttctgagccctaacaatgctttctttctcagattagtatcataagctccaaacagaagttgcttaaataagtgcgttttctttttctcccagtacaagatgtctggtggcaggtaagttcccaggttaacctaacctatagtggcccagagacccagatccttcatatatatatatatatatatattttttttttttttttttttgagacagaggagtctcactctgtcacccaggctggagtgcagtggcacaatctcgtctcactgcaacctttgcctcccagattcaagcgattctcctgactcagcctccggagtaggtgggattacaggcgcccactgccacgtctggctaattttggtatttttagtagagacggggtttcaccatgttggccaggctgtcatcgaactcctggcctcaagtgatccgcctgccttggcctcccaaagtgctgggattacaggcatgcaccaccgtacccaaccccttcctatattcttgctctgccatatgtagcgcagtacatgggccttgtcttcaggctagctatcctcatgaccagaagactatggcaaaataagcatcacatcctgactatggccaaaggcaaaaaatgggctattgcttcttgttagcctttttctttcagatgttgtatttttcaatgctagaatttccactgtggtctttttatagtttctgtttctctacagaggtttcctatcatttcattcattgtgagcatatttcatttatattcttaaatatggttatacaactgctttaaaatccttgtctattaatgcttacaactgagttatcttgagactggtctccattgattcctttttcttgtttgtatgggtcacattttcctgttttttcctaatgtcaaatacctttgcactgtatcctgaacattgtgaatgtatggtgtagggactctgaattccttctattcttctgagaagtattgctttttgtgtttgttttagcaggcagttaacttggctgaactctcaaactgcacatactgtcccatccgctggatgggacctgaaatcttagttcagatatgttagccctacctgtgctgcttggagtctgtcccatacatgtagggttcagaaatttgaggactctacacacagaatttggggctacccatttgtggctccttctcctctccaggattttctcctcatttatcagctatatggtcaccagaactctgccctctggttttttatgccagtacaactgtgggcttatattctagttttaaccaccccacatgaccctgattaggggcttcccttatgcaaaaagctacaaaaaatgacaaacttatccagtgctagtcccttcttccaagtattgtctccaatagccatgtcttttgatcactctccagtgttttaatagttgctttttataattttgtcatgtgagaggtctgtggtccaatgagatctcagccaatactggatgcaaagtttttgttagttcctttttacagagcaaagacatctttctcagaattccccagcagatttctcctttagcttactggctagaattgttttcatctgctctttgttaatcctctttgttctggggcctgcatgcctggaaggatttggctgcaacacactggctggtatacattaatgagttgggttacagcttattcattaagcttgtgagcttagttaatgtgtatccacctcagacatagattcaatctccatgtgctgaccatatcactgtccaaggccccagatgtccagatgtgtggaactttggggctgcctcctcctggtggagttcaacaggcccaggcagaggttgcttgaaccacctgtggttgccccagctaaaaggggagaagcagccacattccacaatctggactggctgggaagctgagcagggagttctagagtggcagcccaaactcaggcaggcaagcactgaaggatggttcctcatcctcccagcaggaggttggaggctatgagataccctgtctctcaggggctggaagagcaaagagcagtatctctttcagacatcctgctgtcagaagttacaccacagcacagtcatacattgggtttaattgttgctcctgcctggcccctcttaaaaaaaaaaaaaaaaaaaaaaaaaaccaaataacctgtaaagtcattttttgccatataaggtaacattcacaggttccagggattaaggagtgtctacctttcagaagatcattgttcggcctactacacctgcttccaaataacccaaagtaattggcaaacatgcactaatctcattaagcttactgggatttcatctgtactcaaattcctactacgtgtacaatcaacaaaaattctccaaccttgtatatcttctcacctcgcagcctgcctataatcagaaaatcaattctatattcatattatatattaattaaaggcatcactaattattgctaatggttcctggatgagaaaagaagcagtaaagattaaagttcccaacagctatgggagagaattcaggacagtgattaagaatgtgtattctaggccaggtgcgatggctcacgcctgtaatcccagcactttgggaggccgaagcgggtggatcacttgaggtcaggagttcaagacctgcctggccaacatggtgaagcctcatctctactaaaaatacaaaattagccgggcgtagtgacacgtgcctgtaatcccagttactagaaggctgaggcaggagaactgcttgagcccaggaggtagaggttgcagtgagccaagattgtgccactgcactcctgtctgggcaacagaatgagactttgtctcacaaaaaaaaaaaaagaaagaaagaaagaatgtatactctgaagccagcttgcctagattcaaatctcagcctcatgaactggcagctgtgtgattttaggcagcttaatctctgtgtaccttggtttcctcctatggcaaacaagattaataatactacctacctcacaaggttgttctaagaattaaaggagttgataattacaacgcacctagaacagtgcttggctcactcagaaaggttaactagtattaccatcaatgcccaaacatggtaaatatacagaaattaaaggacaaggtgaaaaaatctcaaaaccggccaggcgcggtggctcacgcctgtaatcccagcactttgggaggccgaggtgggcggatcacgaggtcaggagttcgagaccatcctggttaacacggttaaccccgtctccactaaaaatacaaaaaattagccgggcgttgcggtgggcacctgtagtcccaactactcgggaggctgaggcaggagaatggcatgaacccgagaggcggagcttgcagtgagccgagatcacgcctctgcactccagcctgggcgacagagcaagactccgtctcaaaaaaagaaaaaaaagaaaagaaaaatctcaaaaccaacactgaaggtactacaatgacataatcaatcaataattaacaatctatttgatggaaacgattagacgatttacactgaagtctgtgagaacttttagaggactctcctaattaaaaagaactccttcatcaacttggaccaccaatttacaggctccctttgaatggactgacctacatcctagagatggacacttctagaagccacatgtcctgctctgccaccactacctgtgtgttgccaagagtaatgagaaacaggtattactgaaaggctttccacaatctgtaggacaactgttctgttctacaaaggatataggactcaggtccaggtattgagtgtggcctagggcaggttccaagtttaattcctacggaattttatctgccttcacaaagtctccacccagatacttgccctgtcctctcagcctcctccatctctcttctatgccccagtagctatccctaccatctcaatgctcacggcttaagatattttcaaatgagaccaagttggttaattcacaagcatcccaaagtcaattgattcgtagcacagccaaagtatcatacaattacaatagactaatttctactatttatacttatctatgggaagagatatctaagctacaaactcttttacccaactcacaagtgacttgaagcccgcaactatacatttggtagaaaacaagaatttgccaactttaacaggactcaaagtaaaacaagatttcagcgggtaccagagctcctgctttcttacactaagataggagggagtgaccagtctaccactccattctactactcgcttgctgctttgcagaagtgtgcaaaacactggccacctaaattactcctatccatcacatcaccaacctatattacttgttcccatcaaaaacagctgccccaggctcagataatgactgggtgacctgaaaagatttaggataacgtcacttcatccaatcaagaaaaagccaagaactaacttgacatctgcaagaacagtgactgacttgacacctacaagtacaattactttctgaggcattgctgggaactttgatggtctcaaagatccctctccatccaaaaaacaagagttactggtgtgcaatcaagagcagtgaaaggtaggcaaactgggaagagctgctcaggaagcagtcttgagactgggatactgaactttagtacaggaacagagtagagctgtgcctggaacttctgcccatgttaagatttccagttcaacaggaaggtggtccaaaatcagtagcatgcccaggctccttggcagacaaactcaaactatctccaaagaaaagcatctctggaatcctacaggtgaagataaagcaatgagcttacaaagataaatacacacaagaaagagagcaagccatcatgaatctgagtcaatgtagacagcccaggttgcaaacagcagaactgtcaaataaagaataagaacaatcaagtaggaaatgtctaaagaaataaatgaataagaaacaaaggactatcaagaatgcccagacagatttgaaaaataagcaaatggaacttattaaaataaaaaataattgctaaaatcaaatattcagaaaagtagcagattagacatagctgataacaaaattaatgaactggaagatataactaaagaaattaccatataagcaagaacctaaattagtttcaaagtaccaagagtccaaattacttctaaattaactggaagtcatgattcataccagactcccacccaaaaacacagtgttttagatgtgttttttacctttacagcttaagagtgttatcttttagatgtcatttcatctttatgagaatccatttaacaaatggcatgctgagatggtcaatgtgacatacataagaatgaaaaacagcacagagactggaaaccaaatgatgaaatccttcaatgaaacttaacataaatactaatttagatcctgttttcatgacctccttgctgggaatgagtcacagaaaataacacctcctgtattctggaccacagaagttaaaacaaaataaaataagattattaacccagagagtagactataaaaggaagaaaagtcattgccttagtggattcttctcacattaggcaaaaatctttcattgggaagttaactctgtcctattcattcttcagatttgtcaagataatgatcaagtccatacttgatccttctgcaaaatgtcactattcctatgaccattttgatacttaatttggcataattaatctatgctgttcctcattttcaattaatctatgctgtttctcattttcagtattctgatatatctcatgtatcagaatatgggctctcagtcttattcaactattatttttaactaaatgttatagttagcaactggttcacaaaccattattcccttaatttgtgaatcatgacttaaatttctcacaatttttacttgcccacataaggcaaatgctgtactctctctctctctctctctctctctcacacacacacacacacacacacacacacacacacagtttttccatattcctaaggaaaatggtggagtggtcaatgtgaaatttcaattctgttggactcatcccaaatctatcaaccctctatgtgatttatttacacacacaaaccccaaaataatcatcactgcctatactttcactagttgacaccaacgaaaagacaaggtgttaatcatgacactttccttaagtgttaaacacaagcaaaccagaatagcaagtttcaaatatttagaattctttccaagctaagcaaaacattctttagcagtgaccacaccacccgccaagttctaaaactagctgtttcaacttggaaaattatatctaccttaaaagttcttatatgtaattaaaagttcttattaaaataataagcagaaaaaaaacctgtcacctaaaagttcattttgatatatcttataccctcttacactagggaggaagggagaacttcgacttaaaaaatgcaatgtccacctagatgacgtcaatacatatacacgtttgaactgcttttcacatcagcgttaagaaatttgggggcaacacaaagatctgggcatttgtcacaggatccaactacaactagacccggtcgttgtcaatctatgatctttggcacctctggatctctagaataaaacttggtccccaagttcttgtgggcccaccctcggcagtcagccctacggcggggcgggagcggccccaccctagctccaggcgatactcacaaacttggggcgcttctccccaggctcctcggggccactgggcggcggagggtgttgggggcccttcctgcgcggcatcttgctttcccggcagccgcggagagaggctgaggaagggtagggagtcccagcggctgagccttgggccgggtggtgcagccgcggctggtgccgttccatctttccccgcagctccggggaccggaaagaaggtggccactcagcaagccgcaagctggaagctgagggatcgacaacaggttttactcccggggtccgccacccaaacagtcagcacagcctagcccaaccgctgaagtcggggccgcagccaacacatctgaaaactcccgccacccgtgttggcccgggactggccaatcccgcgccgccggatca

SEQ ID NO: 591 - DNA, 151956 bp, Homo sapiens
taatatcctacaactctctttatttttaaaatgagatattgggtatgaaaacactgtgagaaagtggaaagtacatacaaataaaaggtataattttcagtcttttagcactgaagatcagagccatgaaatgtttcttaaaaaggcacaaacctttactagctttgtctaaaggttccaaatcatccacaaaattcagtatatcagggtacttctcttcacatatttctaccaggaaatgaagtagcgttgttttctgatctgctgattttgtgtcctttagctaaatagaacaggagggagaaaaaacacagagtcataagtatgttgatattctgtctacttaaataatattaatactgtattttgtagataaggactaaaagttgtaaaattagttgatttcgtttttgaaaaacaaatatttaaatactcgaaaaactacttttgacttgctgcttggtgaaaatcattatttgtcgcaaaaaaggaataagtttaatcgagcatgcaatgttttatagaaaaaaatatggaaaatgcctaggaaaacagagtaacctatgagtctatttaatagtagtatttaaacatccttggcattcatccatttatcacttggcacatatccatagaatgcctactagctactgtagtagttggagacctaacaacaaataaaacatagactttcctcaagaagctgtttagttaaaaaatatacgtatttgccttggtgtgacaaatagtatagtaaaaataatcacaactttcatttaggaggacatgacaatggaactgagacttcaaagacaggaagttgtatgggcttagggaaaagaaagaaaaaatacaaaagtgcattaacacaggctcatggagcagcatttacaagggctatagatgaggaaggatatgacacctctgaggcagctgagtgactccagaattaaagtgtatctgtattagggaaggcatgtagggacatggcaaagatataaatctgaaaagaccaaaaaataaaaggaaagataatggcatgcaatggaagtaggattttgattttgaagcaatataagttttccaactagatgagagatgatcagatatacattttagaaagctccctccagtgagtgtggctaaaaagattagggcaagagtactaagagaagcatgaagagtgagttaaaaacccatggcaataatcaggcagggaaagagggcagtctgaatggaggttgtgcctgggaaatggggacaatgagaccatgtgggtgtggaaacccaggtgatgctgttaactaccatgtcagaaatgatgagaaacagatttgtgtgaggtggccaaagaagaaaattgttttggacaaggtaaatttgaagcttttcagtagtacccaggtggaaatgtcttgaaagaatatacatttatctatctatgtatagaacagtgctttcattattttttttcatgattgccccctaagaagtttttaggcatttttttcctaactgcacctataaaattttaaaatcacaaaggtgatgcatttatgtttatatactgtatgcatatctgtgttttacacctaaaaactggttaaacaagtaagacatttttgctctccaagaaccaactttttatccctgaaagatacctattgaaaatacatggttaaacctcagaggaataaactggggcaccaacttgtgacccctttcctcccaaagctaattagttgatcaaattaacataaacaggtatgtagaatgaatgaaaagaggttacgggcttgagacgaccagggtggaccaatcctaatctgaaatggccaaggagtgcaatcacagggagaggtagttaagctaaaacttcaacaatgataaaagttagcttgggttttgtgtagtgttgggatagaaagtattggcaaggaggagtggtatgaacacaggactaataggtaatctggtagcattccctaccattaagtaatcatttagagcagagatacaaataaagggttaaaaaaaaaatcagtcttttctaccagaatttaatttacagctggaaattcaaggcatacctaattgggcacagtactacttacttgcttcctttccaagaatttccaactttaaaattggctcctaaataaattcccataagtaatattttaaaaaatccaacctcactaaatattctatcactatcagaaaaataccaaataactgttaaagtccagtagtggaagaatgggagatttccgtaccatcagacatattaacatactgactacttattgattcaaaaactatcatagagccgggaacagtgagctacccacctagacagctttactttcacatcatgacacatgtaataggttcaaatgctatgctgacctacacaacatgcaacttatacagtggttcccagtactttaaaaacagactgaatatgaacacttagtccatgatttggtaccttgtttaaaagaaatacagatttcacaacatagagctgagtgttttacaagaggatgcctcaaaaacatgactccattgactacctagacaaatagtcactaacatacgtggatgatttggcaatgttaaaacatgtccttgactaattaatagtcttgagcacattactggaccttagctttcacacaggtaaaataagaaaatgaaacaacatagaaactctaaattcactttttactctaaaaatgttaagtatacattatagtggaactaagagttagtagacacagtacaatttaatttttaaaaactggaagagtggagaaatgtagtaataatctcatttcagagttatttctgtgtgtttgggtcagttggaatcattctatgggcttctgtttttacatatagactcatgaatgtcaaatacaatctttaagtttcgttacaatcctataatttcattcatactatcatcttaaataggtaaggccagattaaaagcagcaaacttttacaaacagttttctctttgcacagccaccaaaagttaacatgaaagttgtattctgttttgttaaaaagcaccctagtagcaaagatcctttatctcacccaccctcatttacagcaatgactacttggggaacactgttcctactctgaattctcggcaacccatttttactagtctacacccttgtagactgtttggaacgttaagacaatcaccatctaccttcacaatttgtaaagcctagaaagagtattccaatagtatctgtgatatagctaaacagccagcaactgctaggattaacgtatcaagaaatctcaatgacggaagaacaaccaactggattgctcttggtctttatttgtaagcaatgagaattcagaatttagaatcatggaaaacaatgtagtttgtagcaacttagtttaataaatgttaaatactcaagtcaaacacagattcgagttattcagagaccattataaagctaaacactgatttaggaggagggtgctaccatgggttgtcttgttgaaaacatcaactgagtagcaagcagcataatgggaacaatctagtattaaaaagtacactcactgaatagtaaagggaagcacaatattcctatcatttcaaaatgggtatttaacaattgaaagacaccactcaaactttcatgtaaataaatttgaaactaagcctaataaataagaggttcagaaaagaagcatgttgttgatcatgcatggtgtctcatttataaactactatgcagctctaaactccagggcagagattcttcatttatgctctaacattctctagaaaaatttcacaatgctgccaagatactcttcctgcctcaactactctattctctccctcccctctctctaaccatcttttaaaaagtcttccaaaagcatcaaagcataaaatgtattaggtccttatccatttgctcaatatttttttcatttcattaatgaaaattaccaactaaaaaggcacattctactcctactcatatcatactcactcatatcataatcagtttctgagctagaacaagtaaagcttggaatacagtgttaattttgttgaagatgagtaacaacttatgtaaactttgtaacgctaaatcttggaaagaaaataaaatatttgctttaaaaatatcttcaggttaaaagtatgctttatttaaactttaacagtcagtgcttgacaggatttcttttgtattactgtcaagagatttatcttactgatgagtaatcatcaccgttaaacagaatttcctatttatgtattgtttctttaaggtacatttaacgtggcataaatgtcaaataaacaaaagatggatggagtttctccaaccactctgttcattccagacaaaataatgttaaaagtggatcctgtaataaatcatggcctagttgtcagtctgcagtaaaactcccttgcagttacagtgcaaggtttggggatatttttgaggtattcagcacaaatctggatgacatttaaagaatattccatttatttagtcacatggtaataatttaaatttaaaccctaaaataaaaactaagcatcttcgtgatcttcagaagtcaaggaactggaatcccttcctgtttgaaataatgaaacttacatcttaagaatattatcacattaataactctactccgcatcattatgttcctataatctaggtatgtatcaaagcagcattgaatatttagatgtttagatgctgtggacattagtgaacaccagaaacaagacaaaattctgaaaaatcttgtaatggcaccattaccattttagaagaatacaacctgtgaataatattaatgctgaggatgacagtagcatcctcagcattaatgtttggtacttaccatgagacagacattagccaaataatataacacatgttaagtgcttaaaacattacaaccccaaactagtattatatccattatttaaaaaggaaaatggaaatttagagagatcatatagcttacactggatcacatggagccaatgattggaacacatgtctgtgtgaatacaaagctcttatccactataaaatatagttcctttacagcaatctttagtctagcttattattaacaaaataaaccaaattctcaaaaaatggcagtaaaacaacaaaagagcactaatgcaatgtaaaatactagcaccctttaacctgttaattctagcctggaaagcatctaaaaacagacaccacactcccttgaggtcatttctagttctaagagcacaacattctattgttttatctgtaaaataaataaaatgccatctgaatcttatcaatcaaatagcaactctttatatatttctaatggattactgctgacaaaatatcatatgattgaagaaaaaggtatctataaagtttaaccttcaatggatttataccactatattttaatagcatcatatcccatctcaaatcttttgcagaataaagtggattgtgtatgcataaaatagcatccctaaaaataaaggtatctacgtgaaaatgaatgtatgaagacatactaacaaagactataacacaattgctcagacagaaagctcaaaaagtcaatgtggtagtacaaattcactaataaaaccaaccaccattatagaatggattttgttttctggtatgtacgtgtgcttgtgtgtgtgcctggtgtgtgtttgtgtgtgtatttgagatgggctcttgctttatttacatatatatttatttatttatatatataaatatttttaaatatatattttaaataatcattgtgctaacaaaatttttcaaaacaaaactgagtatcactccaatacaaatggcaatgaaaatcttgaagtaaataaaacaagatggttgaggcaggagaactgcatgagcctgggagttcaagactgcagtgagctatataatctctccactgcgctccggcatagatgacagagtgagacctggctcttaaaaaaaacaacaaaacaaaacaagcctaaggtgcttatgccactgccataaccacaaccattaatattaaaatataactttcttaataattctaaagatagaaaccaattgatattatataaattagatactaaggcatataaatactaaattacttatggcacccatatataaaaacaatttatattaattacttaatattcattttaaaatgataatgaaaattaaaacattaagtgaccaagaaagtgcattaaataatgtggacttccgtaattataatatgctaccatatccccacacactttctctgaattatatttttaacacatttctcttgaattacagtgagtgtagaaacttctatatagaaagcatttgtgcattttagtaaaagtttagcatactacattatctactgcgttgcactgttctgttcatactgccccctttttcctgcaaaagatataaaacagctcaatgttccttacaaaaaaggactattttcagttcttttagtactgagagatcagaaaacagacattcataacaggcaaatgggaaaaagtactagaataaacaatctgcaagggaacaaatatgattagaatacaaatatattttttaaatgctaaactcggatgatcaaagacataaaaaagatacaagatactgcttcagcaactatatcagcactctccacctaacaaaaacactctcaccaagaacaagaagtcatggcagggtcgcagtgagactggcactttcatagtgccagtctatgaaagccactgcaggcatgcgcaaatcagtaaaacctccaggaaaatgatttagtaacatacgtcaaaaattttaaaaatattcttgtttggagtagtttcagaaaactcactggagtccaacattgtccagccaaagctatgtaactaaactgctattttagagcacggatttcttaatctaataataagaatttctcatgggaacaattaacaaaaattggagtaagtgcttagaaagtgaacatgtttagattgtttatacaaatggaccaaatacattaattttaaaggttttttaacccttattaataattaactttatattttagactttatattttagagcaattttagctttacaggaaaaactaacagaaaacagagttcctgtatacccttccctacacacacacaaattatcctgttgtaaacattttacattagtgtggtacatttgtgacaagtaatgtaccagtattgacacgttattgttaactagtttccacgttaaggttctttctttgtgttctgcagttctatgtgtcttgataaactcagtgttattcatccatcactacaatgttatacagaatagttttaccaccctaaaaaattctgtgtctcacctattcattccttccttcttccctctcctcagaacccctggcaaccactgatgttttattgtctctagacttttgccacttacagaacatcacatagttggaatcatacagtagatagcccttccagtctggtttctatcacttagcaatacgaatttaatgttcttccatgtcttccattggcttaaagagatcatttatttttaatattgaataatattccaaatgaatataccacagtttatccattcacctattgaaggacatattgcttgcttccaagttcaggtaattattaataaaatggctgtaaacatttgtatgcaggtttttgtgtggacttaagttttcaattcatttgggtaaacacttaggagtgtgattactggatggtttgttctacgtgtagctttgtaattgccagttatccaaagttgatgtgccacattttgctttcccactagcaatgaatgaaggttgtactatatacttaccagcacttggtgctgtcagtgtttagtattttagcaatgccagtacatatgcagtggtgtcttattgtttgagtttgcaattccttaatgacatctgctgctgactattatagggacagaaaaattacaactccatcctcttagggtccttgctggtctgataatttaatttgacatgagagagattaacaggagaaacgtgtaatgcaagttttccgtagcacaaaggccatcaaaggaatgaagactgaaagaaatagagtcagttacccatataccggattgtgaaaagaacagttgttaaggagcaactacattaggtgggaaattacttttaacaaggcctctaaaaaattctctttgtttcgactttttgttgttgacgattaaggatgttgcatctttccagtacggaaaggccatcttttgcatgaaaatgttaacttctgcttttaagaaatagcaaggaggtcaaagcaatctttctacacctgctgtttttcaagtatctttaaatagtcaatataccagaatagcatattttaatcccttcaatatcttttcatacatttacctgacacctatacgttttgatgggtatctcttcacatcttttgatcatttctttaaactgggttgtttatttcttagttttaagagtttttgtacattttagataaaagtcctttatcaggtatgtgttttggaaagattttcttccagcctgttttcttttcattgtcttaactgtttgccacagaagttttaaattttaataaagttcaatttatcaattttctttcatagattatacttttagtgttatatctaaaacgtcataataaaaccaaaggtcacatagattttctcttatcttctataaaatgtatagtcttgcaatttatatttaggtccatgataaatttttagttaatttttgtgaaagatattaggtctggcaactttttttttttttaaatgtagatgttctcgtaccttttctttaaaagaaagactattctttcactattgaattacctttgttcctttgtcaaaatcaactgactatatttatacgaatctatttctggggtctctattccagtccattattttaaaattatttttattttttttccctttggccaataccacaatattttccttattgcagctttatactaagtctggaagtcagggagtgtcagatttccaacttagttcttcttcttcagtattgtgttagctattctgggtcttttgcctccccatacaaactttgaaatcattttgtcaatatccataaaataacttgctggaactctcactggggctctattgaacccatagatcaagttgggaagaaacgacaccttaatagtactgagacatgctttctatgaacatgaaatgtctattactttattagatcttctttgatttttttcaaagttttgtaggtgttttttttttttttttaaatttgagatggagtttcactcttgttgcttaggctagagtgcaatggcacgatctcggctcaccacaacctccgcttcccaggttcaagcgactctcctgtctcagcctccctagtagctgggattacaagcatgtgccaccacgcctggctaattttgtatttttagtagagacggggtttctccatgttggtcaagctggtcttgaactcccgacctcaggtgatctgcccgcctcagcctcccaaagtgcttggattacaggcatgagccaccacgcctggccttgtagttttcctcatacagatcttatatgtattttgttagattaatacctatgtatggtttttgttactaagaaaatgatacactattttaaatttccaattccaattgttcattgctggcatacaggaaaccactggctttttaaattaggtgacctcataatctaaaactttgatataattgcttaacagttccaggaggtttattttttgtccattttttttgggggggggggtggcgggcattctacacagacaatcatttcatctatgaagaaagagttttgtttattctgccccaatctttatagcttttatttttcttgtcttactgtactagccaggacttccaacacaatgttcaagaggagtagtgagagaagacacacctgcattgcttccagttttagggaaaaagcatcttgttccttaccattaagtatgatgctagctgtcgattttatgtagatgttctttatcaacttgaggaagttcccctctacccctatttggtgagaatttttctcattaatgaatgttacattttttcaaatgcattttctgcatctattggtgagttttcttctttagctcattgatgatgatagattacattaatggattttcaaatgtcgcacccagccaggatgcatagaattaaaaattattccctctccttctatttacttgaacagatttagagaattgaaattatttcttccttacatgtttgatagaatttactggtgaaaccatctgagccttgttctttctgtttttgaaggttattcattattgattcaagtattttaatagattcagattatccatttcctctagtgtgacttttggtagatggcatctatcaaggtccatttcatctaggttatcacatttgtaggcttggttgtgttaataatattcttccgttatctttttaacatccataggatcagtaacgatagtccctctttcgtttttgatatgggcaatttgtatcttctctctttttctcttggttagcttggctattgatctttttaaagactcaatcagatattggtgggtttgattttctctattaattttctgtatcaatttcattgatatctgctctagtatatattagttctttgtcttacctactccagagtccatttgctcttctttttcttgtttcctaaggttaaagattattctttttagatctttcttattttctaatataggcacttgatgctataaatttccctgtgagcactgcttttattgcatcgaacaaaactttataagttgtattttcattttgctgtttcatataagtggatcaaacagaataattttaaatgagatggttttgtttttttaaaaaaatacagaaacttctgaactttacattaaaggacttaacaaaacacacgcctggtatatctcaggtgatatttttcagtttgttctggtggtggtggattctgtacctcccaatgctggaaccatagttcaaagccacttatgacacatttcttcatcatcctctcccctgtcccccaagaacaaatgttcataagtaccaatggctaagtattactatgtggataataatgttgcatgttttgtctctgattccaaaaatgtagaaacaatgcagacccttgataaaggagaggtaagacacttcttagagtatcaggaatggagtgtcttgtttctggtttttatttttcatttataaaatatataaaagtgaagtctgaattaaaccagggatggtaatattcaccttcggtgctatctctgatggggtagttgtctataagcctgacgccgaggaggattcagaggctgggtgtttgggggaaagggtagtttgatagagaagctatgcttgctatgagagcaggaagatgaaggcacacaagcagcctatttgctgagcctgagcaaagtcactccatcttttataattctattagaagaatcattctcatttacaacatttaacagcaattgaataacaaaggtgacatgaaaataatttaccaaaaacgctatttagaaaagccaattaaatatttcttagaaaatgtcatagattaaatgtgttaatgaatgagtcaaagggggttaagcattctaaatagtttcacattgctttggaaatcagtatttctgtgatttaactggctgcatgtaaaataagaatggcatttgttatttgcaagtctttggcccataactgctttactttcaaaggttgccaaaatttactggtataattttgccaacctaataaagaataaaaatccctctcaaaataccctgaatgcaaatggaacaatggatttgttcggcagagatctttcttaaaaataaattcatagagtaaaggaaaaagtgatacatagggatcaaaacttcacaaaaacgactcacagtgttaacttgtgtgagtgtgacaggtatgcaaaatacaaactgcctgaaataggcaaaggtatcctgtctcatgcttttgtagtcactgaaactctacctgtacaagctagagacttgtaaaatggctcgagaaacaggccttcaacttatttcagttccactatgtgcctgaaattcacactccttttcaaagttttcattttcagagtaatgtttagcttggcatgagaggaaaagcagcaatttttgaaaatattttcaccactttttcttttttttttttttttttcactctttttacccaggctggagtgcagtggcatgatctcggctcactgcaacctccgcctcccgggttcaagcgattctcctgcctcagcctcacgaatagagtagctgggattacaggcgcctgccactatgcccagataagttttgtagttttagtagagacagggtttctctatgttggccaggctggtctcaaactcctgacctcaggtgataggcccgcctcagcctcgcaaagtgctgggattacaggcatgagccactgcgcctggcctcaccactcattcttaagtgaagaagtaaagttgtttcgtttttgtcgtggctttggtgttggttaattttcattttttcatgtttgcttttggttccagatcaccagtcagggattttccattctgggatatgaaagtagggcagaagaccaagcgattcacatttcaagttgagtatgaaaatcacctaggaagtagctttaaaaatgccaccaatcaggatccacatccattctttctaagttaattgaactggtgtggggactgcggcatcagtatttcttaaagggtactccaggttgctaatcaatgtcatccaaaagccatttgtcacaattttggaaagtgtctcattagggttggtggaaacattaaagaatatgagaatttaatgtttgttgctgtttctattgttttaattatctccatcacagctctgatgaagttattctactttttctactttttgcttataaaaggaatatccagaatcagataaaaaattcatgcattagaaaagagaatttaggaaaaattaattttgcctgccaccccctcaccgtcttagcacctactcctcaacgcccatagccccattaccatgtattcatcaatgacttcaactctgagacgaactcattagatattctactgccatagaaaacagaaggcttcctacaaagtgacagtatggataaatttaaagtgggatcaatagttatttgtttctgcaattttcccaaagaataacagcataaataccaataaaaattagttattacacgtggtaaaactccttcaaaacttatatctattaccccaatataggaagtcagttgattcaatcaatcacctggaacaaagagctgcatcatcctgttgtattgatcagaatgatctgttactcagaaattatacatcttattagacattagtaaacattattaaacacatgttatggttattatatgtggattagtaacatcttcttaaatttacaagtcaaaattatctcatatattttaatatggtgttgaactttgatggttgggtcaattcactctttacctaaaatcctttgaaaaaaatgaacttggccctatcaacgtgtctcttggagaaacatctttgatactaaccagatacaaacttttctaggtcagcattttggtcagataagcatctaccatctgccgatttaatttctaaagatatgttttccacttaatcaacagcagtctccccactctcaaaattaatatgatgtcaaaatgatatccattttttatctgaagttcagtactacatttggaggattttttaatgacaagcagtcctccattatttctgcaaggtttatccttttaaaaagtcaagccatcagaaagcaaggtacttacaccattttaactaaactagaagtagcattactgtgactgaaacgtacattttttttcacatcataagggttcgcatggggtgccaggtccttaagaggcccagaatacatattttgggggagaggggaagagaggaggagaaagagagattgttctaaaaaaaaaatcctgacgaaactgactcatttgttgtttataacactattcaacacgttttccttttgtaaagatacatatgcaaaatttcttatgaaggtttaatcagggaaaacactatttttgctcatgaagtgaagtttgcacatcactttgaccaccaaaaagtcaagcacctatatagcaactttaatttttatttagatcttaatcataaattcagttatgtttaccttatatgtcatattttacttttttgtcatatgtcacatgaaatctttgggatataagaaagcaaatccttttctctcgaatccagagatattatagttactcattgccatcctgactacaaatgtctacaaagctatgatacagctccccaaactaaactataatgggcatgaaactcaagtattcatgctcttatttctaaacaatgcaaagttaatttaatatgaattttcatgaatttttcatacttgagttaaattcgtaaagggcatttaaaagtaaggattttggatataaaatgttaaatgtcatataattacccagcatgttttaacagattaaaatacttccttgtctttctactgtcaaatatatatggaattccttgtgtagaagcttatcatcaaaccaaatgctttatactcagtgtgaaaattcaatcacaattgtcaaagatcaagctgctacttctgataacaaatatgatgagatatcatcttgttcaatatatgctttcaacttgacatgtaggctaataaaaaacatgaagttgtagtatttattttgtttcttccacaacagaaggctcctaagagggatgatcaaaatactcagtatcattgcaagaaaataaagtcaactctttatctgcagacagattaactggtttgccgactaactgtagtaaaagaataacagctacattgcatttgtaaaagatttaaaaattactatgcatcagtgattgtatctcaatgagaggatgtctatttattttcaacaacaaaataaacataagacactactttttgtcttatgacaagtttcattcattcaacagctatttattgagtacttactatataccaaccactgcagtaggctatcctacctcattaatcacacctagtctccctgtcaacagctctccttagaggaaggcataaggacatgaggaagagcatgcagccagtttttttgtgtcaactataattctgagatgtaaaacctaaagaggatcacagacacttttgcacgaggaaacagactgtagtacatgtgtggctgtggattaactttcccctatcttgcccctcaccctgtttttcttactttgccttccttctcagggaaagcctgaatctgccattcttgcttgcctccttctccttcagcttccaagttcataaccagcacaccttgacaactcctcagatgtccctgaatttgtgtacttccctacatccccactacattctacctcaaacccttctgccgttaccttagcttggaactccatcatctcaaaacacagtgatagctacttagtggacactcaaacctttgctaaataattgaataaggtagcttcaatcatatgccctttaagatactgaggtaaacaagagtagaataacaacaaaaaacccctgatctcattctcttttgagcaaccacttcaaacatgccagtagcaatatctcccattagttgcctaaggtagatacttaggaattatttttgacctttctctcttctctgccacccccataccatctttcctattaccttctcagtttggtttcctctgttgctctcttaggtctcacactacatgtcaaccaaacaccaaatacctcctcaatgtaaccctctaacccagcgctgtccaataactttatgcaatgatggtaatgtgccatatatatgctgccaacgggtatggacactgagcacttggcatgtggcgagtgtgactgaggaactatgtttttaattttatttaaatttcaactaatttgaattaagtagccatatatgtttcatggcaacagtactaaacagtgcagcttaaccttcttccatactgctgatagacatatcttgctacgaaacatctgatcatattacttgccttacagagtgtgactccataaaatctccatcattaggcaggatattcaaagctctttacaatctagaccaatttatcacctcagtctcattagccccactcctttcccatctagtttgcaaaggtagtaggccactcactgtactcacacatgccatgctataacccttttggaagctgctgactcctgcttagaacgccttttcctctcacagaacatctgctcatccttcaagatccagcttaaattcccatttctctctgaatatctaactgccctctcatagctgagctaggctctctgtcttaactctgctgccataacttttagtatgtggcttcattaaagcatttcatcataattaatggtttacatgtggaaaatatgagtctcatgtatgccaggtaaatattaatcacatacattaaagatagaatctaaagatagaatctggcaaagcatctggcacaggacttcactctgagtaagcccacgagagatgtgccaagtcttcaggatgtgttttaggaattgcatcgcccatgctagggatcttcaccaaatacagctgcctaagaaaacagagaggaaaataaaagaatggagatggggcaaaggaaacactcacaaggcattgatagcaatgagaggcttaggccagggaaattgtataagaaaattcatgaaagccccaatagaataagcatgcagtaaacctataggtaaagcagaacttgtttttcaccttccctaactagctggcaatagcaataatcaaattccttaatcagggagtgtggttgttacgaggtcaagaacaagaaaaaggttttcttctgatgtgtaactgagaagaatttgttgtaagcagatcaataaagccctattactatggcccactcctcaggaaagagctctgttttataaaacattgaatatatttgctgtaaggaaattcaacctatgaaagacacaggagaaaaaaaaggctctaaacttactccattttcatgtcctctagaattatatttagatagaaacacttcaaaatcaataatatccgagttgcatatatttccaatataataatttcccctttatataaaggggtcccatttttctctcctttcagtctgcttatgaaagcaatgcagagaaatatttaaatagttaaaggtaaaaatgttaatggcaatcctaagcaatattcaatatatatacaggtatctgaactgagtaagtacgagtcagtattaataatattttgacgttccatttcattggtttgagaaagcataggtttatgatataattttgttattaaataaaatccttgaattggatttgcagattgaagaaaattaatatttggatttagttcagaggttgagtaaattagctcagttcactctgggtttgagttcatggttcagttcaagttcttgataatgagcacatcaaaataaaaaaatatttaaataatgcaatcagggctgacatttaagagcaagtgttcaggcaaatatgtgtttttaaaaaaacaaactcactttacagagagagctaaggttaaatccgaaggtttgagcattccgggagccagcattcatgtagtttcccattagcaatacaagttccagcaacttgctaaagcttttgctcttctttatctcttcgcaggcagtactgacagccatgatgtcaggtttgatgttgttcacctgctcttcaaactgaagcttaaagagaatagcactgagccgtggccgtagtctcttcacattgctcatctgattgaaaagaaaacagcagatttcctttaaaatgcatggtatagtttagtactgtacgactgcaagtaatctgggatgatttattggtatgacagtaccaaagaagaaatatgtctcctaaaactgatagcaggaagagagaaaagccctgcttgtttttgtaaggaatccagagtcatccctcaaaacccaaattaacaatttagatgctcaatgaaaagaaagctttaattaaatgataatgtttaattaagcaataaagtaagcattttttaaactaaattctaaaaaggtaacaagatacataggccacaaattacaaggcattcatgtcattattttgaataatttttgttcaatactgcaatatactgggtcatgtttaaaacacattcagaaaagtctaaagagggtttgttttcttcaaatagcaattgctgtcctcagaaaccctgctgactaacagtatgtgttagatagagggagagtaaataggtcccaatttgtactaaattgactttcttcagaaacacaggaaagtagaatgactcctgacacatactaaattagcagaatcagagttaggaaacatgggagtagtagcaggcagaagcggtgcaaacccacaaatctatcacatgccaagttaaccctgtctgggactctaggtttctctactgggaatgtgggggactggaggtgtctaaaagaacaaaggggcaagttcctgcctttatccttactcctgtgttatatcaacacacatgcaggaaataatcacttagctgtaggctgaagacataccacatatgaagctagatatgaattccttgaccaaacacactagggatttgggacttaaaacgcactgaaggggcggtaatagtaaaattgttgaacttcaacaactattgtaaatatcaaaagcaggttaaggcaaggtcagaaaaaaagcagtgacagattaaaatagggactgtttctcccttagtcacagactgtaaaggaaaggctaaaaaacaatgctatatgaagcctgtaggatgccaaatataatgaaaatcatgattgtttgggatacagaaagctatcagctcataatataataatgaccgttacttaaaatatactagacaaaggcttataagactccaatatattatagacactgccttaatgactaaacataactcagcttactcatctgacaaaaattgagcaataaagaattagttctttgtacacaactctgagagaatattttcatatagaccaaagccctatagtgaatgaaaagttccattttcaaataatataaatatctaatttatacttagctttctccccagacccttgccaaattaaatggttattcatatacaatcaagattctaagggctcaattaatgtagttattaataagaagtctactttacaaggcactttaaggaacgtcttcatattccactgtctaggaaaaacaaagaatgtaagttcaacaaggaccaaaaaaaaaaaaaaaaaaagaagaagaagaaatatcattaagtttatagagtaagtttaagcgatatgaaattataaagagacaaagatgtactattataatgttgattcttattgggcatgaattgttctttttaagcagtgatcacttatcacaaagacatttgtcttaaaatatattatattttaagacagatgggttcacttacctggattttttttatccttaaccattgcaaaaggaagatgttcatatgacactggtaacatgaataatgctctattacacttaatatgtcctttagagcagtcagacatacaaaagagcactcacatgtagtacctgtagttatggccattctgaaggtgtataatgggctcatagcatcgctgttttcagtaagtgccattattcatgattatgaagccaggtacttgcaatacatatgagaagaaattctccagtattctatgcaaaacatttgtattacgaaatatattaattctaacatatattaatgtactactacattcatgcacagaagaaaaaagagactgcttaaatgcctacattataccaccccaaaatatgttaaagctttcctgctgacaagctaaccatatgtagccagcatagagtaattaattctcctagaaaaatataacctagatttgtatgaataatgagtgtatctggcactagggacaggtaccttgaaaagatagagtaagtctatgatgtaatgcagaacaaagtgctacaagttcatgaaaatccctgacaaggcaaagtcaggaaatgtaacctaaaaacaaagctttgaacaacacttaaaaaaaaaattagatgtccttttcctattgttctttcttccaagtttagataaatcagtatttgactattattgagtaaatgtgttttaataaataaaattattgagtgggaaaagaacttgaaaggtcacctggagaaggtgcctgtctttagttcactatttagtcatatgatgacccctaggccaaatggttgccctttttatttaacaacaaaatatcatttaaggttaatgttccaagatctaaatcatggaatctatgataataacagaagggttacttttctttttttgaggcagagtctcactctgtcacccaggctggagtgcagtggcacaatctcagctcactgcaacctctacctcctgggttcaagcaattctcctgcctcggcctcttgagtggctgggattacagccatgagccaccacgcccggctaattttttgtatttttagtagagacagtgtttcaccatgttgttcaggctggtctctaacttctgacctcaagtgatccacccacttgggcttcccaaagtgctgggattacaagcatgagccactgcgcccagcccttttcctcattatttgaatcaaactttatttcttcaggtggaatcaaataaaaagggttaagaagggggaaaatatatgtatatgtaaaaagcccgaccaatgtttccgcatcctcaccacttctcatattctatcaacactggggatttgcattctgttttcctgctaagaaaactaaacttctgacttgtctaagactaagtggaaggcagaaatgaactatggtgctcaaataatactctgaatggcaacagaaagtcatttttaaaaatgagaaaaaggaaagggtaaatgaacaataaacataaaatgtaagctagttaataattagaatgctagaagaaattagaatttcatttttacagttatcctttaaatctattgttacaaagtcttggcaatataaattcacgaaacccaaatctgacaataatgagatgtaatctgaagatcaatccaaaaaaggaaaaatacattgatttcactcctgtttttcctgaaggcagggagcagtactcctgtaacccccccacacacagatgtcatatgtcagaatgaagagatgttaaaagcagtgactggtaaaaatcaagaagcaatatccagaaccctaagggtaattttatttcaaaattttgtttgttggcaatatatgttgttagagagggaacaacgtaaaaagacctttagaaaaatcaatgaactaacaagtattgactgggccccattcagtgctgtgaggggcacaggagccatagcagctgcccctgtagcccttatcgttgaattctttctgcctgtcttaaggagtataaagtcagaaaggtccccaggaagatgtaatctctcaaaatctcattatggttctatttttcacatataattttatccattattctataaggaaaaaaatcattttttacatcaactttgtttaacaccatatctacttctctttatacattttcttttataaatacaggttgtcagatgtttttttcccccgtcctactatgcagacttaacatggcacacctcagaaggatttattttttattcttttttattcttccctgaagttattatgaaacttcactgttcacttaactctctaacagtatagtaacctgctgactgggaagttactggcctcggtcttaatttataatactctaaaagcattagttcatctactttgtagatatcacattataagaaataacagaaaagcatttcaggaaggtgaaatgactctttcaagtcacctggctagtaggacccaggcctagagctaacttgctgctaatcaactgtccttaccactcagagcatcgcaatgtggaaattaagaaccacaatttacaaaccatctggaactcaagcttcctctgctatgttttctagtaggtaagaatgaactttaatttcttcacagtagttatcaagtaacaccctgcaatgagctctgcctgccacctgtactatctcaatatttcttaccttcctccttaatatacccaactacctcctattgtgctgaatctttaatactttttcagatctacttttgttgtctctccacatcagggatcccacaccagtaactgttagaaaacaggctgcatagtaggaggtgagcagcgggcctgagcgagcaggtgaagcttcatctgtatttatagctgctccctattgcttgcattaccacctgagcttgacctcctgtgagatcagtagtgacattagattctcataggagcgagaaccctgttgtgaactatgcacgcaaaagatctaggttgcatgctccttatgagaatctaatgcctggatgatctgtcgctgtctcctatcaccctcagatgggtccatttagttgcaggaaaacaagctcagggctcccactgattctacattatggtgagttgtataattatttcattatatagtacaatgtaataatagaaataaatgcacaataaatgtaatatggttgaatcatcccaaaaccatccccctgccatctatgaaaaaagtgtcttccatgaaaccattcactggtgctaaaaaggttgaggactgctgctccacactacactctccactcatactctcctattagctaattcttcagttctctatgggagaggtatgataagcaagaagaatgtgaaaaaacaaatgcagttttatgaaagacaagagaaaatactttgagaaagtaatgtgatctaatacatcacagaattaagacactagagaaaaaatttttgagcttgatttttctaatgatataaaaaatatctttcattgttaacagaccaatatgttcatgatctccagaattctcagaaaaaaacacaagttcatttcacttggagaaaggcttcaaaaaaaaaaaaaaagctattcaagtgacttatgcctgaggtaatactcagaatatcaaaactgtttttaaaataaatgtactcttacgatattaaagctgctatgctaaagttatttaagaaaactatacaaaaacaaagtacatatggtataatttttacatatttcataggagaaaggtaaagccaaggcttgtacaaaaatattaaaaggctaaaatgtatattcctccacttagtcaagaaataaacaattggctatagacattagagactgctgcacctttgtttataaatccttatcaattctggatcactaaggatttcacaggaggtccaaatgagttctgaagatactcaggatcatcaagtggtaaagctatgattggtaaagctaaagaacaaagagacttcctatttaatttggcagtctcagcacacagtcttaacacataagtttcatatctcttgaattaaaaagctggcataaaccccagaatcatattagtgtcttaaattcattcatgcccgcttccagacaatccccatcccatcgtagaaaaccagtgttttgatttcaatcactatagcttagttttgcctgttcttgaaatttatattaatgaaactatacggtaaacagtttatatagctggcttctttcactaaaaaaaaaaaaaaaaaaaaaagactgagatttatacacacgttgtataattcagtactttgttcctttttattaatagatttccatgcaagaatataccaaaatttgtgtatctactttcctgctgatggactttccccccaacccaccccagtttggagctatgtagtgagttgaattgaacagagacccacaaaaggtatgtctaaatcctaacctctgctaccttgaatgtgatcatatttggaaacagttttagcatacgtaattaaattaagaatctcaagatgaaatcatcctggatttagggtgagccctagactggagtgatacatctacccagaaacgccaaggatcgtgagtagattaatgaagctagcagagtggtatggatcagattctcactcagagactctggaagaaaggaaccctaccaatgccttcatttatgacttctggaccccagaaatgtgatagcataaatctctgttgttttaagccaccaagatcgtagacatttgtggcggcaaccctaagaaactaatacaggctattttaatactttcgtatgagtgttttcatttctattaaattagtaaaaaatatagtacaaatgtatacctaacctaaaacattgccaaagtgtttttgcaaagtaggttatatgattttatattccttttaccaacttatgttttattctagttatcttttatcttttcatgtttaggtccgtactccattcctctaattattcagtaaggtgtgatgcaggagttgagattcattttagtccctaagatgtatagactttacaaaactatttgatacaaagaacatcattgaatatcaaatgatggtatttttgtgggtctatttctaaccttctagaaagcttagttgtatatccttaagccaaaacttttgccttgatgttaaatcagtagtttaggtccaccaagtttgttgttctttaaaattggttttctatattctatgtcctttgcataccatatgaattttagaaatcatttgtcaatttctataataaaacctgctgagattttgattgggaatgtgtgaaattcctaggtcatgtgagggagaaatgaaatcttaacaataccaactcttccagtctataagcataataaataccatttctttacaacttctttcatttctctcagcaatatcttacagttttcagtagaaaatctgcacatatttagtgaaatgtatcccaaagtatttttagttttttttatgacattgtaaataatactattttaattacatttaaatttttgctgtttgtagaaaaaaataactatttttggtacactgactgtattctatgacctttttcaattcacatagacaattaggtcagctgaaaaaaagaaaaagatggtatactttctttcctctaatgtattcatcttttatgttttcttgttacacagactagtacattataatgctgaaaggaagtaatgcaaatagacacctttaccaggttctcaaccataaaagacaagtcatctaatcattcacccttaagttgagtataactccaggtttctcatggatgtcctttatcaaaatgaggaagtttccttctatttctagtttgttgagttttttcataaaaaatgactgaattctgtcaaatgcgtcttatttcgcatgtatttaggtaattatgatttttctcataattaccttgtatttttttatctgataatatggctaactaattaattttgaaatgtaaaaccaaccctgcattcctgggatcaattccatgtggtcataacatactctccttattaagttcagcaatatttgatgcaaaaatattttgttgacaacttttgcatctatgttcatatatgatattagtttctagttttgctgtagtagattcccttctttgattcctgataccagtagtttgagaatttggttgtctttttcagcgcttcattttcatttggctcaaaataattccttctttggcccaccggtaattttaaattaggttatgcaatttttagactgtggtagatgttctattattgttgttgtctaacttaattctgttatagacagaaaacataccctgcaagatatctatattttgaaaattactgaggcttattttatattcccatatggtctaccttggtaaacatttgatatgcgtttaaaaataatgtgtattttgcagttgttgtagatagtgttctataaatatcagaacaagttggatgatagaagtatcttgattttctaagaatttactgattttttttgtacactttttctagaatttattcaaagaggagtgttaaagtctcattatgattgagaatttgtatatttttccatttttttctgccaggttttgcttcataaattttgatgctcaatttttaggcatacatatttaaaatgattatctcttcctggcaagttattatttttgttattgtatactgatacttcatttcttataatatagtttgccttgaaagataccttcttggaaatacacatacccatgatatttttcatgtgctattttattactatttgttttccatatgtcctttctgcctttttccccactgctatgtttgagtgtttgtgtcccaccaaacataaatgttgagaacttactcaccagtgtgataggattatgacatggggcctttgggggtgattggatcatgagggcagagtcctcatgaatgggattagcaccctcataaaagagggtccagagagctgccttgtccctccaccatctcagaacacagatagaaggcaacatatatgaatcagaaataagtgggccctcaccagaaatggagtcggccagcaccctgatcatggaagtcccggcttccagaactgtgaaaaataaatttcagttgtttataatccattcagtttacagtattttgttacagcagccaaaatagaccaagacaacctcttttatcccttttctgctttgtgttagtcaagcaatttttagtattctatttcgtctactggcttaactatgcctctttttatattttctctggtttgtctaggattaatacatcttaatgtatcaatctaattggaattataaaccctgttacgcaatgttttttattacaaattttctttcaaaaaatcataagaaaaaaggttttatttactatttcaggtactcttcattactttttgtagatctgagtttccatctggcatatttcccttttgcctgaaggacaacttttagcatttcttgtagggtaggaattactgtcacaaactctttcagcttttataatactaaaaatgtcttcatgtcaccttatttttttttaagacatccattagatagagaattctgagtttacagggtatttttttaacacctttctgttgagcttcttgcattttaaactcttctgttgacttctgctgtctattacttctatgaagccagcaaaatcttttatctttgttttcctacatgtactgtgccttttatctttttcctcccctcaagatacttttatcattttctctttttctttggttttccacagttttactaggctgtgccatgatatctttttctctttatatttttcctagttgggatctgctgagcctcttaaaccctaagtttatgtttttcactgaatgagacttttttgtccattatttcttcaaatattttgtcagccacaatcttactctcttatcctttggggactccagttacaggtattttagactgaatgatatctacccaataatacctgctgtttattactttattcagtctttcttcctacataactaagagaaaataatcactataaaactgccttcgaatttcactgactcctctgccatctccaatatactattaaacccacatactaaaatttttaatttagttattgaacttttcaataatttctatatagcaattttttttatagttttcatttccctgcaaatattccttaattatgaccatgtttttctttaattctttgaagatcatttgctttagttctttgaacatatttgtagtatccttattttgtctttgcaagtgaaatccaaaacctgggccattttggacttctttttttcttgataatacatcccattttattattctttaatttttaattcaatattgcattcaatattgaatacttacttacatataaccactctcagttctgtaatatcccattgaaaactatttgttcttatttgagcagtcaaatcaatcactgggtgatcatcttaagttgtatagttcactataaactttgttagtgtagctctctggaaagtaagatttgttttcttagaccctctaacttagtgaaactcaatctccaacctgttttccctggggagttcatcaagacgtgctataggttttattagggtgggtctagactaggtctttagggtgtggccctacttcctaaagcaccagcttttccttatttgattgaatgtcaaatatgctaatgaagtgttaagatgatctctgtaatttggcagagccagaagtacaaagctgaacctctagtatctctgttccactctcaccctgtagcagctgctatctggctagtcttgctcagtgtatgaacactccagctcccaggcacagacacaagggagatacccacgtggactactggagttcctttctgcacaattccttccccattagtgctctgccctgtagataccagctgtttcactgccataaattctgatctttgcctcctcagctcagagaactatattctctgctagaactcaaatctctgtaatttaagtggaaaactgtcaccaagccaaaggctgagtattcatgaaacttttaagtttctgttctctcaagaactgcagcttttctctactggctgctcactgtctgaaaacagttgacctggatattttgtccagttttatcaccgttagcagtttatatatgttttgttatatgtattcctaagcattttttaagttttctgatgttgatgtcaacgtaatttttacaactttttactataatttccgtttttaaaatacaaaaaaaaaaatcctgtacccaaattaaacatgctgtccacatactgcttcacttaattcatcatattctttctctcttcttctccacatatatacatatatgtatgtatatatgtatgtatgtataaggtgctctccacaagtttttccaatgttaaattactgtttctttcctttataattaatagtttatggggagctgtttcgaggctatgtaaatagtatgtatataacctattttcaccaaattttcacatttgtatcaacagagatagcacactaactagaaaaatacagaatctactcaactttattaaaactgaactttacggaccctttcagaaacagcagtaccttcaagagcatgacataaaagtgcaaatgaaccagaatatatctacaataatttcactttaagccacaactgcaacaaaattgtctaacttcagtgatttagttccataagtccagcctcctcttttccattatgtttccaaaatagtcttacaagagtataggtaaagcaaatctcaaacctcataatgagatttgaagagtacagaaaaatgattcctaggcactagatgaaagtcagatctaaaagcaaccttaaaacaatgttgtttgcaaagtgatgaatcacaagagacctttttgcttataactacaaaatgctttaggctgtatttcaaatgaatgatgcatggctggtaattagtatgtgactataatgatgttttgttttgtttttccaaatgaaagaaattaagcagattgtgccataaaatttcaacactacatagatggtctaactagaaagcatcatgtttccataccaaaaaaaccccaaaaattatcatcaaaaaaaaaaaacaatctacaattctatgataaaataaaatgcccccactttttagcaggaatttagtggggaagtggggattttagattttaaatcccatataagaaaaagcagaaactaagaaaattttgaaaaacgtactttgaattagccatcaattcaagttcctgcttaaatattctaggtaattttttacctcgaagttaatcttcagctattaaaaataaattgcagaagcatttaaacagggaaaccactgctaaaagcaactttaagtacagtaggtacctatagcaaacagaaacacaagagtgattgccaccataagaaatgaagtatggccttagtgtcaaaaaagcatggttcatagctgagctgtaatagttaccggttgagtaaacaggtcaaaaagttgcctaatctatgtgatggtaatgcctatttctgcagttatatgaaaatgagacttaactttactcattcattgtgtatcaaatatttattgaacccttatttatgtgtcaaacactgatttaggacctgaagattcatattaaacaaacaaacaaacaagcaacaacaacaacaacaaaacaagaacctggtgcacatggaatataccataagtaagcagagggagaaggggagaaaaagagatagaaaaacaacaaacaaatcagatcattttaaacaaaaataaacgctataaataaatgaaaaagagggtaacatagatagagaatgatggggggcagcatcattataatgaaaacttctataaggaagtggcatttgggcccaagaggaaacagcaagaggaaaacctaaaatgagaacaagaaaatgtatatagctcaaacagtggaaaaggacaagggtagtaaaagttgggattaaagaaacagagactacattatcttataaattatcatgaaactggaaaccattagaagggtcaaagaaaaaactgaaagaattcattggcactaaaagaaatgttaaaagcatttcttcaggaagaaaggaagtgatttcagatagaagtctagatttataaaatgatgtgaataacactggaaatggtatataggtaagtagatataaaagactctttttaaaaaataaaaagacttaaaatttctttcaaaaagaaatactccaagtcctaaagcaccaataatatagcaaaacaaagaataagagtgaataagtcaaaaaagataacacagactcattaaaaatactcaatccaaaagaaggtagaaaaagagtagcaaagaatagatgagataaatagaaaataaatagtaagatgctagatttaaaccctgccatatgaataaccagattaaattaaaatggtctaaacacttcaattaaaaggcagaaatggtcagactggattaaaaagcaaaactcaatagactgcctataaaaactgtaggttaaaagataaaggatagaaaaaggcatagcatgcaatcactaatcaaaataaagctgaagtggctatattaagataacacaaagtaagtttcagaaaccattagagtatttgaagtttgtgaacgacataaaatctcatttaataacaagagtcagtagctgctatgtgaaaatagtatattcaaaacatgaagcacaggtcctgaaacagtaaataacaaatggcaaatacaaaaatacatatggtatgatgaaccgccatagcatcagcatctctaacattacatcttttctcaacaatattgttctaagattaataaccatattttattctactttaaatgtggctttccattgccatttcattaacatttatgaaacaaacacactataagcatggcaacccctgccgtactttcagaattttatttaacaaaagagggattatgagaattcattaaaatactataaatgtgatacttacattctagagtcacttggctaaatcctctgaacttgcaagtggttaattaactacatgttcaagattgatcagtggaccaggtaaaggtcagttagtcacagagtaaaagggaaagctggagctggggaggtaggatccaaacaaaacacaatgcagtcagatccctgaatgcaattccagccagctaatggttttatatctatctttaaaagcagacataaccagtagacattaaagttcttggtggtcttctagggaggcagggtcaggggtagagatacagacagtgtgacacaggaaaaagccctctatgttgcagattagtttattcaaaaataatgaacaagagaacctttttctatgatatttgctaaccagctcatatttcgaacaataactctgcccacatactcttaaatgactaattccttgccttaagtttaatctatgcgattttacaattcttgttttttgctgatgccaggatattaatgacaaaagtgtttctctatattccaaacataaacccattaagaacgacagcttgctgtgtttcttagtattgattgtatgcaatttttattctttgtttctacgttaggacaagtaaaattcattcagggacttctaaaaataaattggtagcctttcaataattcatctggtatttgggttatgctttatttcaagccattgatttggtgggtgcattttgggagcattcagatcaaatcactgtgatacattttttttcaggcaactcctctgcccttcagtaataaagtatacccgttgctattgtctgaggatatcagaagggccaggtctgtgatctgcaatttaagcagaatgggagatactaaaatgtgggaagacaaaggaaaacctactgaagatgggacatcaggtggcattcaggtaacggacataataaaggatgaggctataattaaggctcgtgggcataaaaaaaataggcagaaacctgcgttttaggaagtacaggttgaggaaacagtggtctctaactgctaagagagatcattaatgaggccagcagtcaaaatcatggataattccaaaggaagtggtaataagaattcagtaagaagtagctaagaccacagcagacatagtccttcccaggagaaaaaaaaaagaaagagagaagaaaaggaaagaagtctcccctgcccccccacccctcaaaagcacataaatagaatgagaatagaacagacaattgagcagtaaagaaaaagattgtcatgaagctaattgaactagttttctcttaattacattaaaaatatgaaatgtttttggaaattctgggtcagaacttaggaaaaacaaatacagtgtcaaggaaacttataacaatattaagctgctggaaccttaaatcttttcagaaaatactagcattcaagtgatcagaatgatttaggcactttactgtggctagtgattccaaggagagctacttaaaaaggaaacattgataaaatagggtagaaagactccatttgtccaaaacataaaacttcagtaatgccacatagcttaccataagaagatgacacataatgctacaacaaggaacaaaatattgacagaataaaaactgacctaatgacagtttcagcataaagccacaaactgagaacccttaaacaaattaaaatttatattactaagttttgactatttaatgcataaatgtaagtcaatatactgtaagtgggacagtataaacacaaaaaaaggaatttcctaacatataacaatttgaacaaattcctagattttccttggacaaatatagtaaatcaaattatttggtagtggtgatgctggtggcatataagttagtgctagtgtttcactaaacgggaaaaaatcactttggctattcggtatccgctcttctaaataactgtaatatctagacttggatataaaattggcatccttggaaaagaaagaaaaatagcagtaatggaaaatagcagacttgcaggataggaaacttgatccaatgttaaaggaaaaaaaaaaaaacaaaaaaaaaacacatttatcttgtgaaaagagccaagtctggtatggaagacaaggatgtttaatgacgcatataatttaatacaaaataaaaatataagaaaagcgaaaaagggaagaaaaatcaactcagacaaagactataattaaccaaatacatatggggccaaaacactaccaccctttgtctcaggagccacaacgtgaatgaagttaaataaaactgtttaaaagttgattctgagtatctcagagaaattttcaagtgcttggcctcagattgccagtttccctgttaagctgaggacagaaaatggagaaaggcctactcaagagaagtcagtggtcaggccacaagaataatgagccagacgaggtagtcgacattctagaagtgtacacattcactgggctctttaaggatggacaggggaatcctctcccatttgggtcttttatttctgaagacagaaaatagggacaagattgatcctaaacaaaaacgtaaggtaaactctatttttaaaaacctttccctttgcattcatttacctttttcccacctcctgtgtgcatctaattctttgccaatatatcaagaactctgtgcctaaaaacaacacagtgtggtggaaacaaaatgaaatatggaaatgtaagtttagaaatccgcagtttcaatctttctcttttgcttatggcatgtggaggaggtcttggttaagtagtctattctatatgagtttctgttcttataaccctgaggagctattataaacaatatgtcatatacatgtatataaacatactttgtgaactgtaagtcactaaataaacttcatataactgctatgtaattacttgtctgctctatagtggctcatttgatgcgatattatgccattaacctgaaactccaaaattcacctctctccccgctccctttatccaaaccatcatcttttgagtatcacaagtcacagataccatattttaaaagttaatcagactaaaggaatgcagagtaagattttaatctcctctaggtatcctaaagcattatatgatttacaaacagaaggctgacctgatgttttataatatctcaggtagttacatgaactgcagtatttttggtgggggaggcgggggtggaggcaggggggtcggtccttgaacatacttccgtaacaactattaggctgttattatacacaactcgttgattttaatttcaggggattccgagaaatccgggatacctagtcagagagttagaggtagaaagcttttaaaggctcatatttctagccccaacatgtgcaactaatatcagaagagaagcttattctaattacttttttagtaatttagattatactcttgaaacccactgtgttgaaaagaaaataaataacccagcactgtgtctcaatatgagatctggaagtcacaataattgatcacactgaaatgctcatcagttagtatctacctttatgtcaacccctatatggcatcccctttgctacttttcactgcaatcaattgtgtctacttgaaagccaaagtatagaaagtctggaaggtaaaaattgctcaaaaagagttattaaaaaaattatatgtgttttataaaatcattgagaaagaagagggtatcaaaagaagagagtagaggagagcatctgagtaagattcttattcaagtgttagaagatatgggaaaagagtcagggaggagtcagacattagaagcacaagggagccaggaaagagaacaaaaagtagatataattaatagggtgaaatgctgaccagaggtcaagaccacacaaaatgagaaatgaaaggacctaagctgaatctggaattatgaggttgtctatatcacaaagagaataactctacgacagtgatgggaacaaaagcatatacataaaacatgctaaagaatcgtagaatagtgagagagaaaattcttaatgtaaagtggaatatagttcttaaggaaagtgggtgctggccgggcacggtggctcacgcctgtaatcccagcactttgggaggccgaggggggcggatcacaaggtcaggagttcgagaccagcctggctaacatggtaaaaccccgtctctactaaaaatccaaaaattagctaggcatggtggcgtgcacctgtaattgcagctactcgtgaggctgaggcaagagaatcgtttgaacccagggggcggaggttacagtgagccaagatcacgccattgcactccagcctgggcaacagggtaagactccatctcaaaaaaaacaaaaaaagaataagaaaaaaaaagaaagtgggtgctgaactggatcacaatagatgagaagaaaaaagtgtaaaataaaaataagagaatgaaggctgggcgtggtggctcacgcctgtaattccagcactttgggaaaccgaggcaggtagatcacttgaagtcaggagttcgagaccagcctggccaacatgttgaaactccatctctactaaaaatagaaaaaaattagccaggcatggtggcacatgcctgtaatcctagttactcgggaggctgaggcaggagaatcatttgaacctggggaggcagaggctgcagtgagctgagattgcaccactgaactccagcctgggtgacagagtgagactctgcctcaaaaaaaaaaaaaaaaaaaaaagaaaaagaaaaaagaaaaaaaaagagaatgataacagcagctaacataattgggcatttgctatccactatacactacacacatgcatgctctcctaatctcaccacagctctgtgagacaggttctatattcacgtatattttaacaaacaaaggaaatgaaattgaaagatagtaagaaactcatacaacgtttcataactagatgtggtaaattcagaattcaaacccaggtcttcacaatcagattagaaacacaaggaaggacagttgaaggtttctggaatactaagacaaagttttttttaacccagattcaagtctcagtactaagaacatattgccaggcaagcctcaataagccaagagctaaatgattttagtttttcatatttaaaataaataaagcatctgagagaaatttacttattcattcatcaatatttattgtataataccatatattgtttgaggcattaggaattcacaagtgagtacctgacagaatgattcctgccaccatagatacttatggcaggctaactaggttagtggacagagcgtaatacagtaaatgagaagccgatgagtactagggagaaaaataatgcagtgaagaggtgtaatggttaatattgagtgtcaacttgtttggattgaaggatgcaaagtattgttcctgggtatgtcttgagggtgttgccaaaggagaagattaacatttgagtaggtggactaggagaggcagacccaccttcaatctgggtgggcacaatctgatcagctgctagcatggctaggataaaagtaggcagaggaacatggaaggactagactgacttaagtctcctggcctccatctttctcccatgctggatgcttcctgccctcgaacatcagactccaagttcttcagcttttggactcttggactgcaccagaggtttgccaggggctctcaggcttcggtcacagactaaaggctgcagtgccagcttccctactttcgaggctttgggactcctactggcttccttgctcttcagcttgcagatagcctattgtgggacctcaccttgtgatcctgtgagtcaaaactgcttaataaactccctttcatatatacatctatcctatcactcctgtgcctctagagaaccctgactaatacaagaggaaaagaagtattttgagcaactgattatgcaatttcaaagaaggtgcattgagaagacttccacaaaggacctgtgaaaaaagaccagaaagaaatgagagaacaagccatttgaataactggacaaggcaaggtacaagtgagaaattctcaagaatgtgactggcatgtttaggaaacagtatagaagccatatgattaaagttgccttagccagggggaatggtagaagatgaggtaagaaataccaaggcagggacaaattatgtagagccttgtagactactacaagaattctggactttcctctgaggtgggaagtcattgtagggttataggtaaaacagaacattatgtgactgaagtcgttggctgttgtgttaagaatagactgtgttaaatataacttgagatgctatatcaaattctttcacaaattttacatgcacgtgatataaaacacaagcaaaattttgtaccttttgccatcaattaaaaagaagagagatcaatataagtcacagttgaaatttcaaactttttgagaaactcacaagttattagcagctcaaggaaatagcatattattctgatcatgctgggtttttattagttctaataaattaaagaattgcagagttatttaatatagctgacattctactaatttcaagggaaaaagagtaacaaaagctcataagagaattcattcagagctcaattccacttatcctcccactctacagagaacacaattggcagcatgtgagtgattttttccctgtaatggcaggatttgatattactattttgatggagatttgaactaaataagctcaatcccttgattaaatgagagttattttataaaggaatatgcctgcacacttctggcattttaactttatcttagttcataatacaggaactatatatttattatcatgatgtattagagattattccattttcttccatatgagagcaaggtctggaggcaaaaagttttttttctttcactgcacagacacacgttgtcatggccactagcttctttctaaatgtccctgatgaattatataccctacaaatgccaaatatccctctcaccccaactcatggttagtttttgaaacaaactgcaatagtgttatatataaaatcaccttgtacaattccctaggtaagggattgcaattgtcctttgagaggtgataaccagcagcaaaaacaaacaaaaccttgctgatgatgtgcccctctccagggagaagactgagaaaaacagtaaggtttgcatatttcaccttgcccttcactgcctcttgtgttacatttctaattcactccctcagtgatttcatccactcctatagctttgtatgtgacctgtatgctattggcttccaaatttataactccatccctgaactcccagcttatacccccaaatgcatgcttcatatgtccactaagaggtcaacagacccttagttatcttcccttccataatctgcttctcttgcagactttccctcatctctataaatgggaactcttatctaattttacagcctaagaacctggagttattcatgattcctcctatgccccaaatccaatctgtcagaaactctaattcactattttcaaaatcatccagaatctacttctcaccaatgacactgctgctaagcctgtcaaactaccactaattcacacattaataatgagatcattgaaatagcttgttaaccagtcactggctttaattatattcctcacctcaccctactatctgtttctccatatagctgccagcataacacttctatggcatcagtctgatcatttcacccctttgttaataactcactaacggctttcttaaaataaaatccataattctcacactatggctgcaaggccatgcatgatcaaggccctggtggcctctttacaccgtctcccaccttcactctgccacagccactggcctcacatagccaaactcacttatccctcaaggccttgctgtttgtggtctcttctgtctataacatgcttccttgagatatccacacctctaactaaagtcactccggcttctgctcaactcttacctcttcagaaagtccttcctaaccacacaaattgcacacacaaacacactcatcctaccacttcctgcagagcattcactactatctgatattacattattatttatgcatatattgctaccatccccaataaaaatatatgacaaatagggactaagagaaggatcatcacatttaactcagagtctgcagcaatacctagcacacagtaggtgttcaataaatatttgtcaaaaaatgaataaattattgctgaatcaaggagacaaagtatttgaagaaaatttatcagacaatggtacagtctaccaatacaaactcaaagtctaagtttctccaacaaaatccaagtccctgaaacatccaaagactgaaacatacactactggaatagttgctaccaggaggcattccccaggctgaagtgcagtggcacgatcttggctcactgcaccctctgcctccccagttcatgcgattctcatgcctcagccacccgaatcatctaatgagagtgcaaataaaaatgtacaaagttcttaagtatacccaacctatcagcagtaaaagcaatgttaagtttcaccattaaaaagcctctaattttccatgaatgtcactatatttggttaaatcaatgaatcagttacacattattttgactgttaaacatgtaaagaaaaactgtgtatggttgatatggtttggatttgagcccccatccaaatctcaagtcaaattgcaatccccagtgttagaggtgaggcctggtgggagatgactggatcatgggggtggatttccccctttggtgctgttcttgtgataagagttctcaggagatctggctgtttaaaagtgtgttgcacccccctcccaccttactccttctctggccatgtaagacgtgcctgtttcccctacaccttccaccatgatcataagtctcctgaggctttcccagaggctgatgttgccatgcttcctgtaaggctcgcagaactgtcagccaattaaacttgttttcttcataaattacccagtgtcaggtgtttctttatagtcctagcactttgggaggccaaggcaggcagatcccttgaggtcaggagttcaagacaagcctggccaacatggtgaaaccccatctctactaaaaattcaataaatttagccaagcatggtggcgcacacctgtaatcctagctactcgggtggctgaggcatgagaatcgcatgaactggggaggcacatggtgcagtgagccaagattgtgccactgtacttcagcctgggcaatgaagtgaaactgtctccaaaaaataaaagtaaaaataaagtgacaagaaaaacaatgactgaatgcttatcttaaaagatgcatacctctaagatttaaaatagctagaaatatagttatgaaataatagtttattatttcaaaccaatgttctcactgtgtaatgaaagatttccagacaagattaccaaatggccatctaaagcaccatagaacttgagggaccttggacaactggacaaagcagtagcagtggatgaatggaacttctcttttccaggaagagaagacagtagattctgccaacttcagactgacacaacttatgtaattgacagacgagatcaaagatgaattattaaacagaaaaggaagtagtaattacaagaaaccaaaatgggttcttgaaaaaaattatatcagagtaactgtatgtctttgttaggagactgaactctgggaaacatgattgattttgtatctggacatttgcaaagctttgaaatattcaacacctaaggaatgcaagaaagacttggagatatttagtctgggaaagtgttggtttggtggagatatcctttcagtttcctcacctatcttggtcaatgttttttataagtgtttcagtaagccatgattcttataccaaatcacaatttcctcaacatcttttatgaaataaaaccactaagtactaaaacaagtattgtatagagtaccatgagtagtcacactcaaaacaacatggccttctgagttaaaaatcaggaaaacgttcaatctaagatgttgtactagacaaacctagaagttaaatggcaagatcacttagggtttaagttctattctttaaaaaaaaaaaaaaagtgtgaattatgcaccaagttattgatttcttggtctacttttgaattaacccattttcactcatagagaaatcatctacagattcatttttaacaaaaaaatcaaaaatactcaaaatgatttttaaaaacactgttttcattttattgttcttgctatactttttccatcctttctgttcatctattctttatttcatacattcacttaacatacatgtatatgttatgtggcactatgtgtcagtagatgtgccatgtgctgggaatagaaagatgagcacaatacactctagcctgtcaaaaagttcagagcataaatgaagactgtgacttgtaaaataacacttatattccagtataatacaagccatttagagatatgcacagagttctctggtaacaaagaggaaagatactgaattttgtatagaatgaagtgttagggaaagctccccaaagaggcttcctcaaaggggaaagaagggaaaggcagaatattgacaggcttgagcatgatgctttcagagctcaacaaattgtctagcaatgatgaggcagagagaaaaaaagtaagataggaggtagaaggggaatgttaggaactgcttcatttaaagacgtaatgctgggtgggaaggacgggattacagatgagcctgaggaaacatttaggggtaatgggtatcttcattatcttcattgttgtaatcatttcatggatgttttcatatgtcaaaattaatcaactgctgtactttaaatatatgccatttattgtgtcagtttaccgaaatgatactttttttaaaaagttttaatgctattctaagaattttgggtaaccgtgtgaaaggctcggggagcaactgaaggaatttagagtcagtgaaacatatttaggggcatttcattctccattttacatctttacaagatcctctatttaatcaaattaaagaattaaccaactgctattttccatgcacctgtcatgtacaaaggaccaatgcgtccctaaaaaaaaatcacatctctatcgttaagtgagttatgcagatcttcattttaattcacttttaaaaccaaacttcaaagatgcaagatacagcagacgtcataaataaaaataaaaagacaagtaagaggcagtgagaaaaattgcaaatatttacaagagtagcgctatagaacatataaggagctcttacaagctacaaggcaataaaataggaaaataaacaatattaataggcaattctaagaaaaaatataaacaaccaataaatacataataactgcttcgatctcatttaataaccaagaaatatgaaataagtaaaataaaagtcaccaactaaaaaagaaaaacaatattaatgattatgcaaggaaaagaatcctcacttatattattcataaaagtgtaagtttggccaggcacggtggctcatgcctgtaatcccagcagtttgggaggccgagacgggcagatcacgaggtcaggagatcgagatcatcctggctaaaatggtgaaaccccgtctctactaaaaacacaaaaaaattagccgggcgtggtggcgggcgcctatagtcccagctactcgggaggctgaggcaggagaatggcgtgaacccgggagccggagcttgcagtgagttgagatcgcgccactgcactccagcctgggcgacagagcgagactctgtctcaaaaaaaaaaaaaaaaaaaaaaaaaaaagtgtaagttcacatgccttctggaaggacaatttgacagtaactagcaagattaaaaaggcctttcaatttagcaattcaaagactaagtatgattgtgagatgatttacatctcttcactctcaatttatttaatcctcagaacaatacaatgtaggtaggcactattactgtccctgttataggcaaaataacggtccctcaaagatatccatgtcctaatacccaaaacttttgaatgtgttgctttacatagcaaaagagactttgcagatgtcattaaggatcttgagatggggaagattatcttggattatctgggaaggcccaatataatcacagggtccttataagagggaagcaggagggtcagagaaggggttgtgatgccaaaaatagaagtcagagcaatgctgaaccatgagccaagaaatgctagcagcttctcaaagctggaaaaggcaaggaaataaatttttcccctagagccctcagaaggaatgcacccaagctaaaccattttggactattgatctccagaattgtaagatcataaacttgtgttgttttaagccaccaagtttgtggtaatttgttatagcagcaacaggaaactaatatagtcctacttcataaataagaaaatggaggtatcaaaaaatgagtaacttccaaagatcatatagctaggaagaggtacagctagaatttaaacccagacaatgtgcaatactaatgcactgccttcaaatacaaagatgtatacagaattattttttaaaaaacctgaggcacggagagaaactacaactaagtgtccttcattaagagaatgattaaaaggaaaaatcataatatgggctatgaaataaaatgcacgaatttaaaaacagtacaacatgaaaaacatattcaaaatatatgacacagccaaaaagtttcagaacaatggattttttaaaatgttcacgtgaacatgcatacattggtaaatacacagaaatggaattagaagtacaacagattgttaaaaatgatcatttgtgtggaatgaaaagaggtagtgggatacgggggacatctacattgtattcaatatttctatgttatttgaatgttttacaacaagaatatatgatgtattttaaagcgagggatttttaatgcagggagatatgcacgaatttcctacaacatttttcattaaaaaggcctcagctgcacaaagtttaaaagccctgccctacagtgacaccaaatggtggtagatcaaaatacagcacacaaacaggacatttgttcgattcaatcttcctataaatgtttgatttctttgaagaacaggaagcttaacagaattaaataacgtggagacaaatactcaaaaacctagaatttttaatcaaagaaagtctagtacaccaagcttcaactgcaaatttttaggcctctttccaaacttcagctaatcttctgatcccactgaatatttacataaatcatttctcacagttaaagcatgccactgtgaacacagtgattttacctaatagcttattgatcaaagaaagcctacaaatacaagaaatgcagtcataaaactaaagtcaggctctactccatcggaatcaacccttggtaagtaggtaatattttggaaagatggacgagaaggtgttggggataaacagggatggaaagaatccaagaagagacacaagcaatgactccaattaatgacaaagtatattttcatttgttaatctagtgatagaaaattaagctgagtaaaagaggaggctattgcctctcaaatatacaccaatttctccacaagaaaattttgtcctggactgtccagggaaaagaatatttcaaattaagcacatcagtcagtattcagtgtcctctgcccagaacctaaaccaacaaaaacagcatgtaaatggccttattcattacaagccactataaaaagatacagagatagaccacctctcagggcactcctctaaaacaccatttggccaggatccttagtcttttagcattaaatgagagtttattggatttttgatgtgttacttttcatataccaaaatctcctagaaaacacaggacatataaatatatgatcatctacaaaaaaaagtcaataatataattaagctctaaggccttgaaatcatataactggatttcaatcctaataggtacaagccaacttacgaccacatgttaccagcactactttaccccactcatggataatcagctctagaacaccttgagagctatcctgatcaaatgagtgcatgtccagtgacaagaaccacaaggagatcagttcaagaaggtaacttaagtttctgaattactatataagtgacagatgaacaactaagaactgagtaccacaaaaagtatccatgtctactacatatacatttatgacttaattagaaagagaggtaatatcagcattaaataattttgcttccaatttcaacagagacataaatatgaacatgaaagtctatattacagaaaatgtgaaaaattaggcacatcacatggtttagtggttagaagtttcaaggatatacaatttaatagaaattgacataattcccacagtaaatttgtataccatactctacaggatatagagccctagaaaactgtatctaagtgatacatgataaaagtaagacatatggccgggtgcagtggctcacacctgtaatcccagcactttgggagatcgaggtgggcagatcacaaggtcaagagatcaagaccatcctggccaacatagtgaaaccccatgtctactaaaaatacaaaaagttggctgggcttggtgttgtgcaccaagctgtagttccagctactaaggtagctgaggcaggggaatcgcttgaacccaggaggcggttgcagtgagccgagatcgtgccactgtactccagcctggtgacagagctagactctgtctcaaaaaaaaaaaaaaaaaaaaaaaaagtaagacatttccagtatacaaactatttctgatatatgctaattgaccttaattgacattggttactaatattttagatgtcttacttttacaccctgcctttctatcaaagaggaaaataacataaacatcaatatcctggtggagctacatcttatgttttttaactaattcttatggagaattaaagttgattatataatgcaagcaacttgactgaatttaatctactgtctcaagttagggtatcagtttaaataaaacacaacctttcagaaaaaattgtaattaatatgaatcaaattaatgaattcacataactggataaaagaaaacttaaacttagtggcaagtaaaaactgtagaattttaactaatttttgttcaaatgaaaatgctagaaatcataacatcagtctacggaacctaaagatgaaagagttaagagctaatttttctacagtgaaaaacaaatgaaaagtcaagctttggtcctatttggagctgggaaagcactaacactaccccaaactcttgactttttcttatatctaactgtgtgatgatttttcaggtaaagatgattagcacatttctaatgtactttaaatctaggctaaatcaagaagtaaacatgtttttaaggcaaggatgtcttgtagaaatctggagtttaattcacttcaagttaattgcccatttttgatacaaacacttcaaaaagtttattactttaaaaatgaaacattattatggaagtcttacagaaatacacttggcaattataaccaatttcttaaaatcatcaaattactgtattattgataatgttgataaactgaaaacacatcattctttagtaagttagcaaaggtttttaatctagaaaggagtacagaaaatttcagacattccagactgtctaacactctttgtccagtattttgttttttttttttttggttaattatcaaggattgtttggagctttaagcaggtttcccacttctctttggagagcaaaagttgagaagtagtagcagccagattggaaatggtgaaaaatagaaatggaaaaaggtaaaatctaagaacattactatttgacaaaaaataaaataaaaatatttcattttgttcctcaactttcattctgatttttccaccaatacaattaccttttaaaatattagtaccacagaaaccagaaccgaaaacaatttgttcaagagtatattgtcataatcaatagatgactaaggcattgttcatattgtctgtagaggatgtttttcaacaacgttattccttccaaattatattccactggcactcaggtatgacccagcatggaatgtgtacattccagattaagtttgagttgacatgtcctgaaagggaagtggtccatcaccatcttaaaatcaaaactattacctctagcattggtatctgggaatccagttgttttaactgctgatccctaaaagtacactttttgtaaatcaaagctctttgatgtgaattcttaatttttaacaaggcataacttggctattttaagtaaattgaaaatatctgcaaatttgagcagtcttcttgaatcactagaacacagaaatagttttaaatctttactataatggtaggcaacataaaaagctacttgttagatagacattttcatataaccttgcatggtatcagatttaatgtacatggaaaatatttcaaaattgtaattttatatattattttaattcaagtgtcaaaacataggtaaaaaaaaaacactctaaatagtctgtggttaaaaatgtaatgcaaattctcccttattcacctattctcttatggaagacatggcaaatagagtatcaaatagacaaactaaccaaataatagaaaagcaagcaagcagggaaataaagaaaaaagaaaggagacagaaaaggggcaggcggggaagagaataccctgaagaattggagtaaaaagtaaaaactttttttgttttcttaaagacaacgaatttaaaagttttagaaaaggccgggtggggtggctcacacctgtaatcccagaactttgggaggcggaggcaggcggatcacctgaggtcaggagttcgagaccagcctggccaacatggtgaaaccccatctctattaaaaatacaaaaaaatagctgagtgtagtgttggccacctataatcccagctactcaggaggctgaggcaggggaatcgcttgaacctgggaggcgcaggttttggtgagtcgagattgcaccacttgcactccagcctgggcgacagagcaagattctgtctcaagtatttaaaaaaaaaaaaaaaaaagttttagaataagaattataagactgtgaacaaggaaaatcatgctttttccttttgtgttctatttggagtttttttttttttaactttggtggtagcaaggagtagaatgcgtttatgaagagataggaaggaatgtaaaagcaaatgtctacaacatgccaaaatatgaggtgcaggcacagctattaagtaaatcaacctgaatttttaaaattctgtcaaacaaatttcatcctggccctggagattattaatataactgaagatgaaagggaaaaaataaacaatcttattagagaaacaacactatagtattgttataatgacaaagtgtaaccgacctaaaaataataatttaatggtaggagaaaagagcacagaaaagaaatcttgataaaaatcttaaaattttaagttgtaatacatttaatatatggcattggaaattcttttcacctctttagaccccagcttctataaaataaaaggctggagcaagatgattatcaaagattttctaaaatgaattcatttttcatcctcattgccaagaaagatactatatttataatttcggtctaaactacgagatgaattcaagtaagtgatcagaacaagaaaccaaagctactcttgcaatatgttggaatacacagctctagaataaatcacaaatatacctctctattcttaagaagtacagtttttactttacattttaacattaaatagagagcaaaaaaattatacatacaattttcaaaagccccttggacttcacttaatgccagagtttcaatatatattttaaatcaaggtaatttcacatgaatatccttaagttaaaaaaaagtaagatggatattaaatgtatgtgattactcacatgcttttttacatttagcgatataaaaacagttgacaggttctcttgtttggcacagtataaaaatcctctctgagactcggtacttaccacaaccacaaactgctcaggttcacataagttgctatattcactcttgaactgagacaatgaatttaattgctcttgatcaggaagatgctttattaagttctaaaaattaaaaccagaaagaaagatcttcactaaatgtacttcttgaattttaaaaatataatttaaaaactactgaaagaaaaccagtgaagttaatcttcagttttatttctaggtaacctccctcctaataagccttaagcaaaattccctgcatcttgaaaacagtcaattttccatttctctatcccagagttattatatattcaaatcaagcactactgaaactgaatgtttatttgattagctatataattgagaaagagaactcaacctataccaaaggaacagctttctcacctggatgaatgtgatccattacatttcagctttagggaattaaatgtcagaaatttcaggcaaagccaaacatattttaacacttcactcagggggataaaagaaatcatcatattgctacaaaaaggcatgggaagggacagaatagaaatcaagggaattttaatggcagtgcttgcaagatttaccaataggattacagttttaataataaaaactgaagatatctctaaaacaaactaacttttctgatgtgaaagaaaattttaaaaggtgttgaagacacatgatgattgatataccttgcagataaaaggcatgtagaggtcctttagaaacttaagtaagccacacacttaaacaacagaactacttgaataaagattaaaggaatacacaagactatgtcttcctgatacaacttaaatgattaaacaatcccttggacaaagtctatatcgatcctctgtatcaaaatacaatcaactataatagcgttacaagaagttagtgcattgatattaaaattaagataaaaaagagtggttggtgctcacaattccaaattacagcatgagtaaattctgtacaagcccaaagttgaatacaaactataattaagcctagatcatgctatatatatttatggggggaaattccccaaaggtgttattagttaaaaatactgttagagaatgttatacatcaaaatcaattagatcaaagaataagttattgactcactgtgtacctttggacaaaaacttggttaactggccaaaaacaaaacaaaaaaaaagtggcattttaagatcatccctagacaaagtattcactattaatactatcaaattgaataaaaataaaagtatatgatttccccacataaatagaaatttctcttagtggaattgcttgagaccaaaagacatgattatttatatttttacccattctagttgacagctggattgttagattttattacttcaggcctctgaatttctttagcatccttttagacaaatccccctgaatatctcatatataatcagattttcatctttcacctgaattttttaattttttcactccattaattttacattctaacataaaaatactattgtgatttttaagtgcgtggttccaacctccctttgtctctccccttacaaattccccacacccttcgcaaatcttaagctactgttcagctaaattctgcacagacaggcacgcatgcccagcttccctcacagcccacagtattattactgccaaaacaattgcccttcactacatttttcatgcaactcctctgctctattctacatctatacctattcaacatttacatacccttgcctccacacatacactcacaaagcatactccctcaacatattctataggtctaaaccaatcttaaaactttgcttaccttgctttacaattatgtatgtaaatgtcatttcccttgtcaaattataaattccaagaaggtcaagtctaattcttattgagcctaatatacagccgggcatggtggctcacgcctttaatccagcactttgagagaccgaggtgggcaaatcacttgaggtcaagagttcaagaccagcctggccaacatggtgaaaccccatttctactaaaaatacaaaaattagctgggagtggtggcgggtgcctgaaatcccagctactcaggaggctgaggcagaagaatagcttgaacccaggaggcagaggttgcagtaagccgagatcgcaccattgcactccagcctggttgacagtctcactctgtctcaaaaaaaaaacaaaagtaataaaacataaaaattattgagcctaatacaatgccctggacatgttgcataaaataaagtatatgaaaaatgaattaataaatgactgatgtgacaaacaaaggtaaatgggtaaaaaatgatgcagaaaagtggcatgaaaaatggcaaaacaatgacatactgctgacctgtacatatatatgaataagtaactaaatatgtcaaaatataaccatcacagtgaacacagagaaccaaaatcatgattattacaacataaagctctgtttccatgccctggtcaaaataggaattcttcgcattaaaatgaggaatatacttttaaaattaagagttcaaatagcaagaaattcttactttttaatgaatatattaaaaccttatatatgttcaaaataaatttttacattttagaaatacccaaggctggttttatatttagaaagtatgataggcacaataatgacatccattcctaaagatgtacatgactaatccccaaaacctatgaaaatattaagttacatggcaaagggaatttaggttatagatggaattaaagttgctatcagctgaccttagagtggttatcctgaattatttggatgtactcaatgtaatcaaaaagttcttataagtggaagaaaaaaacaatagagttggacggagatgtgactatgagacaaaggaattgaggaatgcaagattgctggcttggaagatgaaggaatggttctacaagccatagagtatgagcaaccatgagaagctggaaatacaaacagattcttccctagagcctacgaaaagaaacacaggtcattctgccaatactttgatgttagcatagtaagaccaatatcagacttatgttttacaggaatgtaagataataaatttgtattattttaagcaaataagttcttggtgaatgggtatagtacaaataaaaaactaatacattacaaaatatatggagctgaatgtactttggacatgaattttaaaaagcaaatcatctcttttctattatataacaaaaccacatgttcatttaaaacattcatgtaatcaagctaaaagctactctgtaaatatttaactaattcattataagaaatacaaacaagtattaagtagaaaaattttatttaaggaagttggcatctattcctagcaagaaggcacacatataatcaacatgaacgaagatgaaaatccagtaaaaaacaaactgaaagagaaaaaaaatgcttaaataagagtagctgaatcaggtagtttatgagtctcagcgactcacagcacaaatcactagtgaaattatatgaccactacatttagaagacaagataggaaaggcaaaacttagaacaacttccaaagatatcatttattgattagttaaaatattcagaataattttaattgcttgttggcactaataaatatttggtttctttttattgctaagtaatcattttcctaaatatatccgctatcagaacaaaagatggtaagctgaagataatctctcactatataatttgtgttttgattctccaactttaaattttatcaagatatacattattgatttcttatgtggaactcagcaataacttcgacatgatgctagtattcatttgaaaatactatgaataaaagccattaacaaaaatcttctagctttctgaataaattcagaatactatgtaaacaatctctaatactcataggagcccaaatgactctaagaagaattgttagtaaaggtaactgtaattgaaaactccctcaatcttctaaaccatataataatatcttcataagccaaagaaaaacacattctaaaagggctatagaaacaaattttaagtaacacattaataaagtataacaaaaacaaaaatgtaaaattaaacaatttgcttttcagaaacaataacttaaaatacttaaaatgtaatcatttgatagcattctatttcatgtgcagttaagagaagatgcagctttctctcctggcaatgcagaagttatgctaaaactaattatgcagcaatgattttccagttgaatgatttgggtgaagaattttgcttcacttacagatttctatttaatgagaagcttgcaatgaaatattgaaatttaagctgtgcctgtttgtttacctgaatcatagactctgccaaccgtgtttcatctacttccaatatcatcattctgatttcctcatatggcacccgaaaagagctcaggaagattgctaagaaggagaaagagagaaaggtttataatgaataaggtttaaaaaagtatttcagatgtagttctatttataaaatcaaaaataaattcataaaacaagagaattcaaacatttaatattatgtttgggggaaacatattatgggggaaactttcattactacattttatactcttctctagttttagaactagtgtttaaacaacagtcctgtgttattgcactggatccaaggttgatttttaaatgctcagttatttatctaccataggaatgatgtcaattttcatgtgataacaaaaaatgaaataaggtacactataaaaacatcacattgtaatgaaaataataagaaaaccacagtatgtgcatgtaatatttgtctaagcatatgtattatttgcttgtatctcttctagccttaggaaagagttcaggaaaaagtattttaagaaaactgctaagcagtacattaacacttttacaagtaatagtagcacttcactattcagaaacattgtaaacagtatgctagggaaaccttcacatgtaaccaaagcttaaaatatccagttttagaaaacaaattctcactgaaaattatccaaatgtactagatagtataatatgttattactgagaattctaaacatctttcttgatggctcttatatcaactattataatgattttttcaaaagttactgaagtagaaggatattttcacagcaacagatacaacgcttttgctagttcaacccttattgtactattatgtttttacattcaagatgtcacttcttaaccatactcagcacctgcaaatcaatagcctattatttttctttttatttaatgaatttctatgtcatctggtatgtgtatttctagataaagaaactatgttcagcacctcatatctgtgggttccatattcacaaatctgaccaactgtggatcaaattcaatccacagtaggttgaatctaaagatacagaaaccatggatataaaagcagaatataaggaacttgagcatctgtggattttggtattcatcaggggtcctggaaccaatccctctgatatcaaaggatgactattttttataaaactcaggaaacaggatctacttcttttctgtattgaggttgtattcctgatttgtgagaatatcatgtatcacctacagattaacaagggcatcatctgtattcatatcaccaacacacacagttctgaacccaagaagtcttaaatatgaaatcattacaataaaactcacagatgtctataatccttaatatcccaagaacaagatgaaatatgtaaatggtataagagtaaatagagatttggccaggcacggtggctcacgcctgtaatcccagcactttgggaggcagaggcaggcggatcacgaggtcagcagatcgagatcatcttaactaacatggggaaactccacctctactaaaaatacaaaaaattagccaggtatggtggcatgtgcctgtagtcccagctactcgggaggctgaagcagaagtattgcttgaaactaagaggcagaggttgcagtgagccaagattgcaccactgcactccagcctgggcgacagagtaagactctgtctcaaaaaaaaaaaaaaaaaaaaaaaaaaaagtaagtagaaatttataaaattacaaaagacaactccgtagtagacaatagaacatgcaaaaaatataatcactgaagatggtgaagtagggctctccagtaattctccaccctcacagaaacatgaatttgaactagccacatgtgaaagaaaataccttcaaaagagagaaaacaagtgaaaaatcacagtacctggtatagactaatactaaaaaagatacattgattatgtaaagaatgttttacatcacccgtatcaatccatccaccaacgtcaggcagcacaggaaaaaaaaaaaaaaaagagagagagagagagatactgtccacttgaaaaaaaagagaagtgaacatagaaatttccctttgtcgctaacaacaaatctaccagtataaaatgctcatggactctgattcctgacaggtatctgcagtctaagcatctagactgacactggtaccagacaggaatctaacggtcctttgagaaaagactcgagttctggcctatatcactgacggatgactgcagcgaccttcgtttacagaaaatactcagtggcaaacaggcaacagaagccatgggcttcaggaaccacccaggactgcaacaacattaagaaccacgaaagtaagcctgatgcagggccagctgtgggagccaaaaatttccagcctgggctgcaccacccaaagcacttctaggcttagggcactccctaacactgcaccaacaacagcaacccataccagatggtctactcaaaaaccctagacagacttactgttgaaagatgacctaaaataaagtcacactgagaagaatggaataaatatctacttcttcaacatgcagacagcaacacttgaccacaatgcaaaaagacaatcagggaaacatgacatcaccaaagggacaaaatcagctgccagtgatgtacactagagatggacatgtatgaactatctggcaaggaattcaaagctgtggtttaagaaagttcagtgaacttcaagaaaatacaaaaaaaaaaaaaaaaaatcagtattttttaacaaagaaaacagtttttaaaaattaaacagaaatactaaaatatacaaggtacaaaatgagaaattcagtagagagcatcaactgtacaagtgatcaagcagaagaaaaaaatctgtaaacttaaagacagtttatttaaaaatatactgtaagagaataagaaaaatgaatgaaaaggaatgaagaaaacgtgaaatttattggacagcattaaagagcaaaaacgtgtcattgaggtttgagagagtagataacattgtagaaaacttattttaaaaagtaatagcagaaaactttccaaacctgcaaaaagatataaatatccagatacgggaaggtaaaaggtgtctagtatgattgaatccaatactacaccatgacattataatcaaactgtcaaagatcaaagacaaagaggggatccagaaagcaacaagagaaaataataaaatagcatacaagagagttccagtatacctaacagcagacttctcaacagaaaccttacatgccaggagaaaatatgatgacatattcaaagtgctgaagaaaaacaacttctaagaatactttaccgtcaaaatttatttttcagaaatcaaggagagatagagtttcccagacaaacagaagctaaggaagttcacaatcaacagccctgtcttataaaaattgctaaatgaaattctgccagttgaaagaaaaggatgataatgagaaacataaaaatatctgaaagtataactcaccagtaaaagtaagtacatagtcaaattccgaatattctaataatgtaatagtggtatgtaaatcacttgtatctttaaaagggagaatagaggacaaaactattaaaattaatagtaactacaataaattgttaaggaatattcaatatggaaagatgtgagttgtgacatcaaaaattcaaaattcaaggaaagagtaaaattaatatgtagttttattttttataagtgatcaagtttatcagtttcaaataaattgttgtaactgtaaaaaatcttttagttagcctcataaccacaaagcaaaaatctatactaaatgtactacaaattaaaagcaaaaaaatcaaaacatactattagagaataatcacttatccagaaaggaaaactgtaatagaggaagaaagtaaaaaggatctacaaaacaactagaaaacaatcaacaaaacggtagttataagtccttcactatcaataattatctagcatctaaatggactgaattctcaaattaaaagacagagtggctgaatgaaaacaaaacaaaactacaactatatgctgactattgaagactaacttcacccgtaaagacacatataaaccaagtgtaaagatagaaaaagatatgccatgcacatgaaaaccgaaaaagaacaggagtagctatatttacatcagataaaatatactttaaaccaaaaactgtaaaaggagacaaaggatattacataataaagtgatcaattcagcaaaaggatgtaacacttgtaaacatatatatgtgtatatgcatgtgtgtgcgtgtatatacatatatatgtatatatatatataatttgtatccaacaccaaagcatctaaatatacaaagaaaatagatctacagggagacatacattgcaatacaatattaggagacttcaatgcctcattttcagcaataaaacagtcatctagacagaaaatcaacaaacatgaactagaaaatgaactctaggccaaaaggacctaacagatatttacagaacatttcatataacaaaatcagaataaacatccttctctcaactgcacatggaacattctccaggacagatcatatgttatgccacaaaacatgtcttaacaaatttaaggagactagaatcatatcaagtatattttctgaccacaatggaataaaactagaaatcagtacagaagaaaattcaaaaacttttcaaatgcatgaaaactaaacaacatgcttctaaataaccaatgggtcaatgaagaaattaaaagtcttcaatataaaaatgtatttagaaaattgaaaagggaaacacaacataccaaaatatatgggatatagcaaaagcagatctaagtgagaagtttacagaaataaatgtctacactaaaaaaaaaaaaatctcaaacaacctaacattgcacctggaggaattagaaaaacaagacaaactcaacccaaaattagtagaagcaagaaaatattaaagatccaagcagaaataaatgaaatggagaccagaaaataccaaaaaaaaaaaagaaagaaaaaacaaccaaaaatttcatttttggaaaaaataaaataatcaaatgtttatttagactaagaaaactcaaataaatatagtcataaatgaaaagatattacaactgacaccacaaaaataaaaaaagaattatatgagactattttgaataatttcttatacatcaataaattggataacctagaaaaaaaatggataaaatcctagaaacttataacttaccaagattgaattataaaacaatacaatacctgaataaaccaataaccagtaaggaaactgaaattagtaataagtagtttcccaccaaagaaaagctgaggatctaatacatttgctgcttaattctatcaaacatgtaagtaaaaactattaccaattcttatcacactattcaaaaaaaatcaaagagtagagaatactgccaaactcactccacaaggctggcattcccctgaaaccaaaacctgcaagaatgcaacaaaggaaagctacttgtcaataaccctgaagcaaaaattctcaacaaaatgaattcaatacatgaaaaagatcattcaccatgattaaatgggattcattccagagatgcaaggatggttcaaaacatgcaaatcagtaaatgtgacacaccctattaacagcatggaagacaaaaccatataatcatttcaatagatagaaaaataatttgacagaattcatcattcttttatgataaagaattttaacaaattaggtatagaagaaatgtgtcacaacacaataaatatatgcgttatatatgacaaacatacagctatcatcataacaaacagaaaagttgaaagcttttcctataaaatctggaagaagataaggatctccactttcaccacttctattcaacatattacttgaagtcctagccagggcaattaggtaagagaaaaaaaataggcagaaataagttaagctgtacttgcttgcagaaaacaaccttaaatataaaaaatcataaacaaatgaaacttataaaactcctaagccttctcttgatcctagtgtctggaaacctttatgaactcaaaaatataggaaaccaaaaccacttttaaatagacaagtagataaatgaatgacttttagattctttctccaaagttctaatctagtacatacccataatattctcttcaatgaactttagaaatgaacctttccattttagtatcagtattctactactgaccactgttttatttcaatttatctcattccaaaacagttctaagactcatctcagaattcagactctcaaaactctaaatttcatgacaaaaaactataattacaatgaagatcataggctgctaaagcttcttaaagcttaaatcataatgcctgctaccatcagagaggagaagaataatcttaaaatggattacatcataatatgacatggtataaattctgtatcttttcatcttacactttaaaacatgtttctcaattaaatgaataggatatatatactctagctaaattaaacaaggcaaacaggatctttctccataaaaatgttattctgttttctgtaaaaaggaacagatatacattaaactatataaacattaaaatattttcaaaatgagcaatcttattgaaatcacttaactgctacacccaccagattccctacctatactgttaatgctaatacccacctggtggggttgtagtgaagattaaagggccaaatacagaactagtaaacaaaggtaatcagtatttattagctgttttaattaaatttgaaatcccatgtagaacatgttctgtaatacataaataaataaccgtgttcaaaaagttatttaactatgagatggacatttaggctaacttaccacagctgacccattcagaaagaattctattaaacattatatttcttcgggaactattacaagactatttagaatcaacactagtaatttgtaatgcaggtcatgaacatttttcaaaataaaatcatctcttttagatcacagatacggaactttctgacattatctgacatagttcaaaacacagtgctttgaacctagacaaagttcttttgggagggaaattccctaaaatatgtacatcatgcaaaaaacaaaaaacacaaaatctctgtggtctaagcaaacacacacaaattatttctcatgaagaccatatgttcatcacaccagtttctgttaattattaattatgatccctatatcaggatgatggacaccactctgaatgccattctgggtgccagggggagcttcttcaaccaccaatgaaatgcttccaccccaaaaagtgacattaactccactcccatcttcactggtccaagcatgtcacttggtgactcctaacttgacaggggcagagatgtgcaatcagcagtgcccagaaatagagaattgaatactagacaatacaccaatgccgccatactatccatggggatcttggcaggcctgcattgtagaaaagagatgggtttagatcaaagtgattacgaaggagaggaggttctgaaattttcataaaaggaatgccaactctaccatttgaatatattgcctctaacataactctctctttaatcagtagcatggatctttatcctctcgctgaagaactgttttattccaatacttgctaaaagctcagttgaggcatgtaataattgagggagactaaaaaccatgttaattcttcatcactctagattctccccattattcatatccctcttgcaccatcagaaagtgatatatacagaccatagtatatcatctctaagcataactacctttgatgcatttagagtagttagaaatgagttaagagcaaaactatttgccttcttctctcacagtaatttggtcaagaagataatttaatactgagtatttagctcctgtaacagtaattaaatctaaaatatttctactcagaacttttgaggaaaggctttgaactgctcagatgggataactgaattcactttactcaccatccttatttccgttaatattataacctcctttatgtgtgatcaagtatcacaaatattagagattcagagttataaaagaagcaatacactaccaatttttttcaaaatatgatgtcattacctaaattccttaagtctttatttttatactttaaaaaaagggactttaaagagtagctgtttttttttttcagttatgaaaggtagaatttcattttaaaacctcttcttatttgtattttctaatatgcacttatcttttgaagcatttaatcccataatttacctaaaggagagttatctgtgaatttatcatgcatataataacaaaatgaaaatagcaaataatgaataatcggtcttaaagaaaatgaaatcatttaaagaaatatttccactgtctttgaatggtattggaatatgatacttacaaaggttctgggcaattttagaatctaaaaacttaagttctttaatttttttcttaatcgatttcttctcttcaatatcttcctcttctcttctctctgtaaaaccaagatagatccatgttaggggcagcaattcattcaaatacaaaagtggaaaaagtgaactttttatcattaaataagctaaaaaggatgtaactcttctaaataaaagttataaaaacaaataaaacgatagatatcccaagacctgaactgttgaagatagaaactgggagcttttatgccagagaaactatggaaagtaaatatttgaaggtctaacaggaaaaacaaaaataaaacttatgtatactatggaaaccaataccaatgggtataagaataactacaattagctcatttgaatagcatacaggatacagttataaaaattaaaacacctgcactcaagttgcaagtatattaattggattatgaagctagctctaagaatgctaactaaaacagtcattttatgtctaatatacaataccattcttatttaaaaacataccttatgaaaaattaacagaataaattttattgatcgtgaatgttgaatcatctatgcatccttgaaataaatcccatttgatcatactgtattatcttcgtgatgtactattggatttgttttgctactattttgttgaggatttctgcatctaaattcatcaggaatattggtctaagttttctttttatgttgggtcctcgtcttgtcttggtattagtgtaaagctggccttgtagcatgagttaggaagaattctctcctcttcatatttttggaatagtttgaaaggaattggtgttagttcttccttaaaaccttggtagaattcaacagtgaagccatccagtcttgttggaagactgatcaacttccttactcattattggtctgctcaggtttcctattctttctgatttaatcttggtagctacgtgtccagaaatttcttcatttcttctaggttttccaatgtgttggcaaacatttgttcataattagactctaacaatcctttttatttctgtggtatcagttgtaatatctccttttttgattttgattttattcatttgggttttctctttttcttctaatggtttatcaatttaatttaaaaataaaacaacttttcatttgtttaatctcatattgtttgttttttgtttgttttgagacagggtctcactctgtcacccaggctggagtgcagcagcataatcacagctcactgcaaccttgacttctcaggctcaattgatcctcccacctcagcctcccgtgtaactgggactacagatgtgtgccaccacattcagctaatttctttttatttttcatagagacagagccccactatattgcccaggctcgtcttgaactcctgccctcaagtgatcctcccacctcagcctcccaaagtgctaagattacaggtgtgagccacctcacccagcaatgtgtcttctttttttatctgtttcatttagttctgctctgaactttattatttctttccttctactaactttgggtttggtttgttgttttcctagttccttgaaatacatcactaagttcttgatttgaaatctattttttatgtaggcattttttgctacaaacttccctcctagtactgtttgtgctatattctaaaggttttggtatattttgtttctactttaactcatttcagaaatattttttattttcttaatttcttcataacatattggacattgagactaattgtctaactggacattagagaagcaagctgtataatttccatattatttgtaaagttcccaaagttcctgttgttgatttctagtgttactccattgtgagctacaaagatacttaatataattttgattttttacaagttgttgagacttgttttctggcctaacatatggtctattctggagagtgttccatgagctgaagagaagatgtgtgttgtgcacctactggatgctatgttctgtaaatgtctattagattcatttggtctacagtgcagtttcagattgatagttctttgacaattttctccctagatggtctgacaaatgctgaaagttaaattctccaactacaactatattggagtgtctctctccttgtagatataataatatctgctttaaaaatctgggtgttctggcgctgggcattcacacatttaaaactgttatattctcatgctgaattggtccctttatcattatataatgatcttgtctctttttatctctttttgacaaagtctgttttgactgatacaagtatagcttatccctgcacactttgacttttcatttacatacattacattttttcaatccctttgctttcagtcactgtttatctttacaggtgaagtgagttattgtagacagcatatatttgcatcccatttttttaatccattcagccagtacataactttcaattagagaatttacactacttataatcaaggtcattaatgggttagcacttacttctgtcattttgttgatcattttctaattgttttgtatatcctttgtttctctcttcctctctgtttatctttgtagtttggtggttttctgtaataacaatatttgcatcctttctcatttgtgtgtctgctctatagggagctttttacttttatgtgttttaacagtggtagatacagctttcttttgcttccagatatatgactcccttaagcagggagtctagcagtgatgaattccctcagtgtttgattggctgggaaagactatttctccctcacctgtgaagaacagctatactgagtaaagcattcttacctgacagttattttctttaagcattttgtaggtatcatccaattctctcctagtctgtaaattttctgctaaaaaaaattgatgttggtctgatgggcattctcttatatgtgacttgacacttttctcttgctatttttataaatcactctttgcctttgccttttgaaaatatgaatataatatgtctcacagaagagtttttgagttgaatctatttgggaatctttgagcttcgtgtatctggatgtctatttctttcccaagacttagagagttttcagctattatttcattaaataggttgtctatgccttttcccatctcttctccttccagtaatcccaaaacacaaatatatatttgcttaattttatcccacatgtcacgcagactttttaaatctttttctctatttttctttttttggtttgtctgggttatttcaagaaacctatcttcaaactcagaaattatttcttgtccttgtctagtctactgatgaaggtcttgattatattttttatttcctttattgaattatttgattcaagaatttctatttggctctttttttatatctatctctttgttgaatttctcattctaatcaattgttttcctgatttctttatattgtctacttgtgttctctgcgcttcactgagtttccttacaatcattattttgaattccctttcaggtcttttataaatttctttttatttggggtgtgttatgggagaattactatgttcctttgaggtatcatgtttcctttctttttcagatttttttgtgtgtccctaaagtgatatctgtgcacctcctctaataatcacttctaattttatagagtagctttaataagctaagactttttcctgcagatgtatttacagcatcgattaagtagagtgtttggagttttgggtgggagcagccacatagtctctgtgtgatttcttcagctataatcatcagcagtgtctgagatttcctcagtggcttaggctgcagttgtttgtggaggctttggtatgactttcatagtgatgaagatgaagagccaaacccaaggtgggtctgtccttgagcccaagtggcatgtatatggataccagcaggccctagtcacatcagtccttcatccccggggcagcaaacataggttctgggaagactagtccttgggcccctgggggttgtacttggggaatggcagtaacagtcaggtggcacatgtgatcgtatggcagtcccacactggaggtggcgaggtcgctattggacaaaattgggaacttgataagaaagaagagtgtagcaatgtgttttggtagatatgtaaatcactaaaggtaaagttcaaaatctgaaatgctccaaaatctgaaactttgagtatcaagatgacactcaaaggttatgttcaaaggaaatgttcattggagcatttcagattagagagatttggattagaggtgctcaacccgtaagtattatgcaaacattccaaaatctaaaatacaaaacacttctggtccaaagcatttcagataagggatattcaacctgtatattacaattatatattttggtacatagcatgaggtaagaatcaaattttccatttttcaaaacatttgatatttctgtgtcattttatataattaaccatctttctcaactgattttaagttacactttgatcatataattagtgtctagataagttatttctatttttctgggctactagttctgctacattattctctgtgctactgttaacactgctatcaccctgtcttaagtactatagatttatgatacgttttattcattggctgttcaaattatttttctccatatctaaattttgttcttttttttttttttttttttttttttgagatagagtcttgctctgtcgcccaggccagagtgcagcggtgtgatctcggctcactgcaacctccgcctcccaggttcaagcaattctcctgcctcggcctcctgagtagctgggatttacaggctcatgccattatgcccagctaatttttgtattttttttttttagtagagacagggtttcaccatgttgaccaggttagtctcaaactcctgacctcaagtgatccaccggcctcagcctcccaaagtgttgggattacaggtgtgagccaccatgcccggccctcatttatttctccacatgaactttagagcaatccaaaaggtctaaaaataaaatccatttgaactgtatttgaattgcaaggtaattgcaaatagattctgagagatttaatatcttgacaatttctgaacttccttatcataaacatggcatgtgtttataattattcaacttagcacagtgttcttcatacatgacctgtatattttatgttaagtgttaggtatccaaaggacatttgtactcctaggtattgtgtagaaactttgcctaattttgtatacatgttttataatcaggattttacttattttgtctttcattcagataaaaaaaattattaagcaactaaaaagagactgtgttaggcaacaaagatacaatgctagacaagatagagaaattccttgcctcaaagaatttaaggtctaatagaagtgactataaaataaatgacaattataatacatggatgtattagtgatgttatagtgaaaactacacaagaataaagaagagcaccctaactatgcttgtcaaaaataatccttttgggataaatacctaagcaaagcttgaaaggaaaaatgagtcagccaggtaagaaggtgggggtatgtgggaaagacacaacaatagaagaatagtatttgaaggtgtaaaggtgcaaaaactctaaaggcactgaaagacttgaagataataagaacagaaaatattaaacagaaataaatgacaccagaaatgagtcaggtaccagatcacataagatattttaagccaggctaagacatttggattttattctcacactaatgaggagccactgaagatttaagcacatgagacatcaggataactatattttaggaaaaactcaggctaaagaaggtggattagaagaatggcaaaaattacaatagaagggcaagactgaaggaagttacagtaatccaaacgaaagtcaatggtaccttcaccaagggcaataacaacagggaaggagagtgtggatgagttccaaaagttgattctgtagtgggaaatagactaattattgatccagcccaaatttgtctcttgaactccagacttgaataaccaactgctccctctcaacatctttatttggatgtctaatgagcacctgtacttaacatgcccaaaagcaaactcctgacatatacgtgcctacctccatatctgctctcccaactattttcttcagcttaaaaaatgggaatgttctttttgctattttcaagtcaaacgcttgaattttgctactattcccctcacgataatatcctatccatcagtgaatctagtcgattctaactccaaaatattcactaaagtaatcactcctcaccattgccctggctacaatttctctttttgtggccaacatattttttcacctggaccacagccggtttctaactagtctccttgctttcaggcttgactagctgtagtctctccactacagtgcagcaaatgaatcctgttaaaaacttagtggcaaagccttcccttactgccttatatagaaagcaaactcttcacctggtgttctctatcaccattgttctgacttttttctccttcaaagcacttactccttacatatcataaatttgatattgtccctcttcctccattagaagataagatccttagaggcagaaactttgattgtcactatattcttagcaccaggattaaagcctggaacacatcaggtgctcaacaaatatcttttggatggacatacatgtggtcacttgtgtgtatgtatgtatgaattggcagagtaaaagagaataaagaggatactcaggcttaagcaatcagatagatgataatgatgatgtttatttagataaacgatggtgatgtttatttaattcagcaacagttgaggaacaggtttggactagtccagtttaaaacatgttcagttacagaagctcttgtatatccacattagtcatgtacaagaggcagctggacatacagatgtggagaagagaaaatgggaatgatgatacaggtatcaatcctagtaactactccactaactgtcacaggttttccagataccatataacaacactttcatctccttattcccagaatttaaaacttgtttctggtcttgttgtattagttaaaattttcagatgaaggctaataaaaaagttagtaggattcccttccttaacctgaccaaatagcaatcctcaacttctcagaaaatgtatacattttattttcttgtctttattcttaagagcagactgtaactttttaaaatgtttacttttctcatcattatcagtatccttttacattctgaaacatttcgtagtctacctaaagaaaaacgtcaaagacacaagtaaccgtaaattttaaatcacatttactgaacccctattaagtactgcactgaaggctttctgtttccgtttcttatataattctcattatagtcatcctaatactactactagtatcattgtcatcatcatcatcacaataaggaaaaataacgcttagggtaattttaagcaataaatctgataaaagaatgatgaccacctgacttggactccaatattcttttcactatctatgaagtatgttaggtgtcacagtttaaaaaaaaacaaatacaagcaaccttcaccacttcaacctccaaataagacactgatataatttaaccaattctaccttttgaaaataaaaatgacaaattagactcacttaatttaatgtatcagcatactcaggatggtgagtatatacccagtaaggtaatcctcttctaccatcttcactgctatcatatagtcataggattgttgggacaaaggatcaatggaacttagatagtgagaatatggacaaagggatacaaagaagcagaactgcctaagagagaaaacaacagaaattttaaaaccaaaagagaaatacttttttgttgatatgaagccagataatgagtctattatacaaaaagattgatttggaaaaatctttcatattgagagataacaaaagttttgtttgttttttattttttaatgcaatcagggctgcatcagtggaaaaccagcaaaaatgttttatgcaaagaccactgataaagccgcacataaatgttggcaacaataaggatgaattaaaaacaaatgagaataaaggaggacatttagtgagaatgaagtttttgtacaaaatactatttctgctagccatgctggcaatacctctggtaaaatactagcatgcctggaggaagggcagggtcctctgtctgggaactcaggcctggaatcctgacaacaggttctacatcccagcctgccacatgctagtagctaaacctcattatggctgtgattgctcacctatgatatagggatactggccctctatgagtagttgtgaaaatgaaatgagatgataaataccttcatgtaaccctccccctgtggtgacaaagaagagtacgatcagagtccataaacacaatttagcattcaagagtaaagcacacttcaggctcaaacccatgaatcggtggagctactcttctaaagccagtacaaaatacacttactctgaaagactagattttctcaaatataacatgaaactctgaatcataaagtcagattattagtgccatctatacttgtgatctagctttgttgccattagagttttgtgtttaatcttacttcctagagatgctgtgtaaggctccatttttccaagagaagattaataccgttcaaaaactgttctgatcactaacacagcatatgcagcattttataagggttttatgtcagaatgaagtcaaagatgacaaaagttcctatgttgccaagagccatgaactgaaaaagtctcttttaattacattttctcttcattctttttctattttcaaagtttcaaaaatagtagcaaaattatgtaaagaatatcatttcaaaatcctttctttcatactaaattttccatttaaaaatcataattccatgtcacatggttatacatattattccagttcattttccattatgtactaatcagattgattaaaaatatagctttttaggagtaagatttcatataaatgttatcatacattatttcaccattgcaaaagaaaaaacacctcagaatatgcagtcttaaatgttttagtagtcagtataggcataaaaggtaataaaaaccagttttctctttctataactgagtattttaaatcagtaaatgttactaataagtgtttactctgcttttgttggtgctccctggttaaatgtatcttatgacaataggcacttaaaatattaagccttttaagtttttttctggtatgcctttagcatagatattattaaattttacatgttaatgtttataataaattacctttctaaatagactgtaattacactagccttaagagtatgaaaataagtatatctgaataaataagcaagcattcttctctatgacacagagagaagataataaattcaactcaactaaaaaaataaagtaagcaaaataatttacctagaaaatgaaaaacaccagtccctgacagtcttcaaatggggagatatctatgaattacttgcataatggctgttatttttctttgccttctaactcatgagattctaagaggctgataaagagtatcaaaatttgaaagatacaaatttttgaaccagaacggcccttcagtatggactttaaccacctcattctataaatcaggaaacctaagcagagaatataagctacatgctgaaggtggcacaaggcttggctatgagcagacctgagaccaggaactgaccaccacacagcaagcctagagcatcctctgggacatggaatttgcatgaggaaagcagtctgcaaccaagcacattagaaaggataactccccacactttgcatttacacttgatccaaattttcccttgctgtacatgttcaccaggacagttagtggaaactgaataggcctgagggagggaagagaaatgtttagtctccagaacacaataaacaggatttaaagctttgggaaataactacacagttgactcttgaacaacacgtgcttgcactgcacaggtacacttatatgcaggtatttttcaataaatgtagtcagttttccatattgacagactcccatttgcaaccaaacacagactgaaactacagtattctcaagaagcaaagcctgtggatatgcaaggtcaactgcaggctgggcagaaccaactttaggacttgagtatgtgtggattttagtatctgttgggttcctggaaataatcccctgcaaatacagaaggatgactctggttccaaaggaaaagtcaagaatgcgcctatcactacctctcaagtagtgggtaactttgctttggatagggttcagttattcagcaatatagtagaatggaatacacttgataaacttaaaggtcagaaatggagaataggcaaacgactgagaaaaaaactaaatttctgagagttaacaatataggtggttgataggacaatatggtttcaaagaaggtttaggtagctcaaaagcaaatgatacagaatacataggaaaaaaagtcaaaaaatttggaatgtttttatgagatggcaatagaccgttgggaaaatatcgaagtaaatgctttggtattgaaaatcacattgtataaatcactttagtcatatctggcttcccaaaccaagttttaatatttctaggcacataaataaatgggtgtgtacctaactacatagaaaataatcagtggagaaacagataggctatttttctattcaaatactaatatatgactgccataactaatcaggatattttactagcaaaaagaagtctgtttgacaattcaaggctaagaattatataatatataggaagagtagctgaagccctaaataaaattttgtgaaacagattatttcaactgtagcaatcataaaaaatgtagcagataaatgcgtatttctctttctgtgacattctgttttagcagacaatgtcacaaaacaaacagtcttgaaggtcttttttctgcaagtcaagtcctacatggacaggaataagaatctcactacttaataaacccttcattatgggtatatctagattttttttagccatagtcatatgtacaaaagaactgttaaagtatcgggaaataccttgttaaaaaacttaaagtacatacctcaaaacaataaagatttttacaaaggctacctaaagaatgcttcccctacctctttaatcctatatgaaattaaaaatcaaaatatttcataaaaactgcttaatatccaaggaccttctaaattataataattagcaactttgctcatctcaaaagtacgacccctacaaaaagaaccattttattgaggtctccttgggtataatcaccccctcataaccaaagatttaactagcagaaaaacaagagttcaaatcaaataaaatattaacaccattcaaaataacagatgaaacaactttttaaattcacaagctgtggattagggagaaaaataatcctgaaaagttaagcctatctatcacatatatcttagtgttaactgggttcattacaatttgagatgagctctgactgaatagatctaaggactgagagaagaaagtaaaagatatcaggaaagagagttcaaaacccgactgaaggaaaactgaatcctgttctaacatcatctatcttggctcatcacaacttctccagaaaacatccataaatttttatgtgccctcaaaatctcaccaccataagaaatacttctagtatctggcccctgtgaattcttcttgaatgttggtgtttcccagtcatggaatcatacatgtatattcataaaaattaatttgtccagctgggcacggtggctcacgcctataatcccagcactttgggaggctgaggtgggcggatcatgaggtcaggagatcgagaccatcctggctaacatggtgaaaccccatctctactaaaaatacaaaaaattagctgggcgtggtggcgggttcctgttgtcgcagctactcgggaggctgaggcaggagaatggcttgaaaccgggaggcagagcttgcagtgagctgagattgcaccactgcactccagcctgggcaacagagcaagactccatctcaaaaaaaaaaaaacataataataataatttttccactatttttacgtataacattctctcatatgttctctgatggtagaaatatatctctgctagaataaattacaaaaccaactctgaaagttaatgtatgacatacgaagacatatacaaaagaaagtacaagagaggagaaaagtcatgagtgagaactcagtgtacattcctaatttagaagaactaaatccaaatgataacacaggtaattcaggatctctagcatggtgtcgaatggaaagagttgataaaccagcttactagtatttgtacacacaatgctaagcaacttgagactagaagaagtaacaatacattatattaacaaacagataaaaagcaatgccacattaaatcataggcagaccatcctggcatattcctggggaaaacagaacacaatcatcaaaacagccagagtgattatccaaaacttgatagaagagaagtgatctgacacaaaaatgaccattattccaaaatactgaaaaagaattgactgacagcaaaatggtcaagcttaagtagtagaattttacaataaacttacttctatatttgatgacagcatgcctataattttgtgatcttgttttgggaggtggggaggcaggggaggggacgggaagcaaaaaaagaaagaaaatgctttattgtgtggggaatggagtgtgggtgtgccagggtagaaaagaggaggagaaggtagagacaatacctaggtatttgttcaactgaactcaacttttattatctggactttctgatacgtagttatcctgtctctctctctctgcttttacgttcttgtttttgatagctcagttgggaattcaagtcacttgcccagtttctcagttattaaatctttatttctctgtgctctaagaataatgccccagttagcattccagatcattctggtctccaattggtctagctaattggagttccattatttgcctgatctgtgttctagaataaactattctgtgctagtttctgtccccacaatctcctgaatttggaatttttattaatctgggctgttaaaatttgtagttctatgttatcttaccttctggctggagcttgtgttgtgtacatcctatatagctatttataacacccggcttgcagtggcacaggcctgtaatctcagcactttgggaggccaaggctggagtattgcttgaggccaggatttcaagaccagcctgggcaacaaaatgagtactcatctccacaaaaaacgtaaaaattagctgggcatagtggtatgtacctgtagtgctagctactcaggaggatgaagtgggaggatcacttgtgcccaggagtttgaggctgcagtgagctaagatcatgccactgcattctagcctgggcaacagaggcagaccttgtttggaaaaaaaaaaaaaattaataaaatgcccagctcacatacagacctcttttccactgtaccatctaactgcaacccaaatgttccatatacacttccctagtagtataaggaggtgaggttaaaggaagactagcaggattcattttatattgtgattagaaaatgatatttttaaaaataatcttcctgagagagtagagaatggggagttagtgtttaatgggtacagagtatcagctggagaagataagttctaaagacggatggtactgatggatgcacaacgttagtgttgctaatgccacagaactgtacagttaaacatggttaaaacggtaaaattttgttatgtattcttaaccacaacatttaaaaatagaaaaaaatttctttatgaggcttgatttcaaatcactcattttaatttgacctcttgatttgaaaatttatgtaggaatcatgtagttaaaattttgctttgtcaaatgaagaacaaaaatctaagtggctgtaaaattaatcagaccaaactgggatcatttaaaatgtatacgttctttcccaagaggtgttcaaaggcagagttggtccttattcactgcacacctcaaacttatacattggtttgactatttatataatgatatagataatgctgttacaaaataacgatttctcttctacctctcacccagattacctctccaaattgtacaaagaatttcattcttgggcaattcagtgtttcaagaacctaatcgcatttctatttccttgaatacccagctctcagatttctaagcttatagtagcccatatcaattactccgtcattaaaggtgcatagtgataaagccagggcagacttttacatgaaaggaagatcttcatcttttcctacacagaaactgactctcttcagcttcttgttctttgtcgcataaagacaggtggcacatggataatgtatagaattagattctggaaaggaaacccaagccatccttatgcttaaaagcctcaaaccatttacccaggaccagagaccagggagatgtatttggaatattcagacaaaagccaagttaacaatgaaatggctctttatctaggtttgttgtggatccctgtatatacatattgacttatattgactaaggcaaagtcaccttttattttctagttaaacaatacatatgtatatgtatctacagggagaatgaggcgtgtgtgtgtgtgtgtgtgtgtgtgtgtgtgtgtgtatcactaaggaatcccacaggaaaaatggagagctaagccaagtcaggattcagaaatccctggatggtttataatccttcaagccccaacaaaaactccaaagaatataaaataagcaatactttcatccccttgccaatgtccatatttaaagttaggctacttataaaatgaaaatctcccaatgttttcgagcctgcccccactcccctaaacaatcttaccttcagtgtaacaaccaaatctgctattaaaaagaacgtacttaacagagctgtattgtgaaatggggagcgaggtaacctttcgttaatgggaatgcagtggcttaaattgtattagaaatctcactttaaactcaattactttacaattatgtttggccacctgacacttgggcagagaagaattaacatcttagtgaagaagaatctttacaagaactgaaatatcccttactgtaaactccccaacctaactaattaaaaactatctttaaatgcttcatgaaaatgtcagaaagtaaaagtttttgttcaaaagacatacaccaacaagccaacgcagaacagaacaatactaaacagaatacctctgacatccaggaacacctattaattgggactctggctcatgtcaaaatttctaatctctaaaatgtttgaataaatcatattcatatgcttaagactattttacttcatgttggaaacatcaaatctgtatttcatataatttcttgaatttctgtaagactcaaatcctttttttcccaattaaaatggacagtgggatattatctaatggacagtggaatatcatctaattaaaaaaaatctccaataagaaaccattatttccaataagaaaactaacccataagaggctaagggcctggcaaatgaaaatgaggactctggactctcattcttgtgctgatgccatcctggccattcaaagcctatctagcccatcagtagaaactgcaaatgtgatgacagaagaactaaatgaaattaaaagcagaatgactaagattcattctaccctgcagagaaagtagagccagataataattggagatgataactggagattaatatttttctttcctgaaatttgtccaatagccttgccatttcaggatcaatggcatttatttcctctggggagaaaagataaaccctagaataagaggtcattcctgagcactgagtataaaattagatttctgttaatatctacagtgagacaatagtcttgaaagctatgtggttcaattgcaaaagctggttacttacaggaaaaaaaattaatgcagtcacaaaacattcctttaactatataaaactgagaatagggccctactataaggagtggctaggaaggatgcagcacatgagaaaaggacagagtgtcagacatagggaagacacaaaagcccttcctgggccaagagagaactcgcaggggatcagaaggacaagatcagaattcatatacacctctggagggtgtgctctcttcctcctccctcatggtgcaaggctgaaggagagccacctggggagtaactccaaagaataactaaataactaaagagatattagagacccccagagcagagggtatttgtggccagcttcctgtctggacctccacaggaagaccgcctcacagaagcctctaccaatatggggcaagcgctagagacaaaaatagtgcatagtatgtttagacaagtgtgcttgtgacaatatcttgctttgtaagtggttaatgggagatgtaaaagcactaaaagagtcagcggacatattttcaaaaaatatttactacgttgcactagatttttcaagtaacaactgaaaaattctcattggatataaaatcccctgcaactcaattaggaaaaaaaatgtatactagcagcaaatatcatatttcatatttcaaagaataaggcagcaaagaaggatggcaaaaaaaatctatttcttcccaatatgtacatgcaaaggcccaaaggcattataacatataaaacacgtatttctattgacctatgtaataccttatctcaaattatcaaatttaacatcttatccccatacttagctcttttggcttagtttcccaaatactcataatgatttctcagcttttcacaagctgctccttctaagcctgaagaagatatatatgatttttcacttcatcaattacttccatcctcaaatttgagcaaatattcttcaggataaccattatacagatttccttcattacaaatgagtgtcccttttgatcacaggcaccatttggaataattaactatcaaatatattgctttctgaatggagtttattgaattaatgtaaccctgtgtatgtaatatacttgacaaaaatttctttcactttgaaaagctaaggtcatttctaagctgtaactttaaaaataaaacaaatgactcacagatcttgcaacaatttttttagattcatttatattgactaaggcaaagttgcctttttattttctagttaatacacatcaaaatatataaggatttcaaaaaaatctaaacatgctattccagctaattgccatattattctagatttgtcccccaggaaaagatattgactttttaaagttcattgtgaaacaattcaaacaatatagaagtacaatttttaaaaagtaaagtttccccacacattaatacaaatattccccaaaggaaactattgaaatgatagttattgttaacaaaagctactgctggtagccttctgaaaggctacacatataagtgtataagggtgtacataaacaaaaaagatgtatacacatgtatacaaatatacaattgaagggtttttttccttaattaaatgagctcataccatatacattattttgcattttacttgtttcacaaagcaataaacccagtgtaattttccatgttcatatgtctagatcaacaacatttgttttaacagcttcatagcatatcacctggtaccataatttggctacatataataatttagctattttccttattaatgagcatttaagttgtttataaatctttgctatcaatattactaaaatattcttgcatatttttccatatatatataagcatttgttgcatctacttttaactgtgccgatgtaataatctcgttctcttatgagaaaagacatatgatcaatttaacaccgttagcacatttcctcttctatcgagtctgaacaaaatgggctttctggtttttaaaaaaagtttattttggcagtttatttcttaatgtcaacgaagatcagcagtttcaaagaattgtagaatgttaagctaccaagaactcttattttatagatatgtaactaaggcctggagaattgatttctccaaggcacacagctacctagtggtagattcaagacaagaaatcggcttcctgcttctagaccactgttactgtaccacactccatttcctggggaaggacgaacacagacacacaggaccaagaaagccctgttagaacaataatagcaactggaaatgtaatagctctcaatatggagctcctctgagggcttccctgtcatgataaagaaaatcttaatctatttcgttcattcattcactcactcactccctcccaaatcactgagttaggctctctatagaagaatacagaaaagtcaaatgttaaggcttgctcataaagaatctcggttgaaattggaacaataagatgtgaagatgtgaagatctattggaacaataagatgtgaagatataaaattatacaataacataatcatttatataaagtgaaaagcattacagagttcaagcaaattctgatatttattctatcagaagcccagtaaaagtttattaaaaggatagtaaatttttcaatgaccaaaggctttgattggcctcaattatttgaggtctcactaatacttattaataataacaattactactatttccttgaggccaaccaagggaaaagatgatggaggctgggcacggtagctcatgcctgcaaacccagcactttgagaggtcaaggtggaaggatcacttgaggccaggagttcaagaccagcctgggcaacatggcaagaccatgtctctacaagaaaaattttaaaattagctgggcatactaactcatacttgtagtcccagctacttgagaggctgaggcaggaggatcccttgagcccaggaattcaaggttgcagtgtgtgataatcatgtcactgcactccagcctgggtgactgagcatgacactgtctcaaaaaaaaaaatgatggaggacttagaaagttaaaagaggcaataacatctcagtagatggaccaggaaaatcttcacaaagtaaatggtattacatgtaggccatgaatgattaacaggggacaaaactggaatgcattcctttcctctcttctctatgaagagctattttccaaatataaatatatgcatttgtatacatacagagaaagaagcaaactatggctctgaataagttttccatacagtgtagaagaaaatttgactaaaatatagatgaatccaaaagctttaggcatttgcagttttattttctggaagacaactggagaataggaacacttgtttcaaaaattatcacacataaccaatcttcacaaggaagcagaatcgtaaggactcaaatttggaaagaaaaattgatagatttgacttctactgctacccataccttgtgtacaatgggatttttgatagtttgtttaaatatatacatttattattaatgcatagttgaattaaaaactactatgtttaacactaacttgtttctagcaacttttctgtgtgttagaaaaaaagggggggggctattatcctttatacctccttttagaaccttttagaaaggagagaggcaaaacatgtggaaagaacttgcccttagtaatcaatctttccaggctcataactggccactaactaacttgtaacaccaccactccctcttgcgggccagcaacaccatcatcaacatctacataactatgccctaagctaggggtatttcaatattgtaccaatgcttcctttgcccctaccactcctactgctggattggccctcaccttcctccctgctttcaaaaatcatatactcatgcttcaaaacaactcaaatgtttctttgaagattttccaaaaaatccacacctcaaatctcatctcctgcccttgtctccagtcacactaaacttctgatggatcctagatcacagattctttccaatctgaggaccttccatgactatcctctctaaacacacccctcatcataccttgctcatttactttcatagcacattcaaaaactacagtcatttttgttggcctatttattttctgtcttctccattagattatatactataggaaagcaagaagttatctgctcagcactgtatcccaggagctaggacagtacctttcatgggagaggcatccaatgttatttgctgcttggctgaataactgttcagctggctgcatgatttgccatgatggacccagtaaccaaaacgagagccctgcttactgatagcagatagctgcaatcctaggcatagtactaagtagcagctagccttgagggaatatgacttgtatatccaatttcacttgctgacagaaaaaaaaaaaaagccacactagcactaagacttaagcacttaatacaataggaatcacagagctctgagaagaaatagtccttaagcacaaagctgctgggctaggaaatagggaggccctcttccacagaggaatattgacatgagaaccagggtcaagaggtacaggtgagtatttctgtcctgtttccttcatgactcaaggttaatttacaagtattttccataacaattataattttaccaaaaaaagattaaaaatctatgaattaaaatttaaatgaaagcttcacatattaaaaatatgcttacgaagaaaaaatgaagacgaacactctggcttattactgaaagcttatacattaagtaggcagtgagttacagagagctgtctccatagtggacataaaaaataagaaaatatttctcaatgatcaacaaataacccaaatatgtcaaatgatatctctactggcaacacttttatggcttccatacttagcgctcagatttttttcatctattaaatgagaaaatgatagctatgatctagtaactttacaatcctatgatgattgaacaatcttccacttttttgtacttctgttacatgttgcaaagcattgtgttcctattatattgtcctttcagctaaaatggttaagtaaaaacaaatatttgcacaacattttacagtttacaaagcacagaatccagtttggatacaatgcaccaagttcaagattattaatgatggggaaagtgatgagagaaaaaaacctcccgaacactacctgataccattctttacattgttcatttcttccaaaaaaagagaagtatttgaagtttatgctcaatagatagcatatgaaacacaatgttcacaacaataaattttaaaagttcctaaagagtatatagacagctaatttgaagtagcacacaaataaacaaatgctaaaaaagcacttgagtcatttaaaatacatgcaaacacacaaagagaaacaaacatgttgctgatgagtactggcccatgcttacctacttagacagctattgtgtacaatattttaattcaatcatacttaaaattgcaaagttattcttctaaaaatgtaagtacataacggatatgttattttttttaactataccaccactgccaggcacaactttaaaataaaatgtaatacaaaaatgagaacatttgaaaatctggtacgataagggaaaaaaactcttaagataaaatggatgctgaagtgttgagttgcacccaggggtcaacaacattgtgtctattattcagctgaaacacagaatttgcctttagataccattttaatgttaaatcaagaactgtcaatcagcaccatttgtttgtaatccctcatcagaacccattgcctcagtctgaacattcataggaaagaatgcagagggcatatctgcaaccacttaaccttcatcaaccaacattcatgcatgctcattaacatttttttcatcccactttcgagcatgacacagctcataccggaataataactcgctgataattgttctagacaacagctggacaggcagagtgcagaggtgaacattctcatagattatggggtactgtaatgcattacaattagtaaaagagtcacatgttcgtgttgaatagctttcaacagaagtgaaggaaatgtcattatcacaaacagcaatctcctctaactttaactctgcatggtccaccgcctgattctcttaacgctttcctattttgaaataaaccaatgaaaaacattgaccctgttactgtactatttcatgaaaagaagtaatatttttgatgtgttacaatcagacacgatctaaatttgtgatttaatttaaagacagaaaagcaggaggagggagaggaggaggaagagaagagtttcacatcttactaataacaattgttttgagcatgatggtgtacacctgtagacccagctactcaggaggctgaggtgggaggatcatcacttgagccccggatgcggaggatgcagtgaactgagatcatgccactgcactccagcctgggcaacagagcaagactctgtatttaaaaaaaaaaaacaaacaaaccacaatcgttttgcatgaagtcccataaaatcattatttattatttttgctttaaactgtcaattcagaaaaataaattaatatcactgaagaaatctggaatatcaataaaaaaggagtcctacatagggaagggaatttagaatccagtccaacatcctattcataacagctttgatagctacttctttgccataatgcaataaaaataaaatggaattaatatgataatgataatactagttgccatttttagagtaatgtgagtcaggtatcataccaggcactcaacagacacagtctcttaataatcctaaaagtagtattaactctctttttcagatgagaaaattaaagctaatctgaaagagactgaaaattcatcccaagtcaaaacattatggagacaggattccaaccaggtagtctgattccaaagccgatgcttttcacctggcttcatggttaatttccacattagaatcttgtttattttccattatttcatcccaattccttggctgtacaattctttgactctgtagaattagacctatttctagaaggtctttattccaagacatagcatttatacttccacattttctactctccttgtgtccaagaaacctgctcttaacactcagataatctctagtccctgtacgtctacctagtttccattacacttagtttttgttgttgttgtttttagagatggggtctcacttggtcaccaaggctgaagtgcagtggtgtgatcatagcttactgcagcttcaaaactcctggcctcaagtgatcttcctgccttggcctcccatgtagctagagctacaggcatgggtttatcaggcccagtgtgttttttcgtatatatgttgggtgtttgtttttgtttttgctatattgcccaagctggtcttaaactcctggtctcaagcaatcctcccaccttggcctcccaaagcactggggttgtaggtgtgagctacctcaccagcccatgctttagattttctaatcaaacttcttaatgtggttctttctacaccctttctctgccttgcttgacataaaaagaaagaaggaaggaaggaaggaaggaaggaaggaaggaaggaaggaaggaaggaaggaaggaaggaaggaaacttcaacaaatttcatttaaagatctaatttaaagatcttatacatgattcattaatcaggtagcatctcatctaaaaatgtagaaaagtgccacaataaactgagcagagatggttgattttatagctagagaaggggtaaagaaagcaggaagaaggaacaaaaaacagactggtcatttttgagttactttctttatagggttaaaacaggggacttccttatcatataggctcaggtaaaataggccccttctgattggctgctgcgaatctcctatttttcagaaaactggcacatgttaaagttcaatttgattaaatggcacctagcacaagtgactccattctggtttgatctggcatgttaaggccaagtgcaacagcttagtaaaagacaatggcctcccatgaattttgtttagcaacatttagtcacaaatatctgggagaggggaatcaagaaacctaatagatataacagtctatatctctagtcctacttgtgattggtgctccttgttgaaggaaatcacatcacctgcaatgggatctactataatttaataatataatctgaaataaaacctcagtaatataaccagggtcagcaaactatagccccatgggccaagaccagtttgctacctgttttaataaatgaagtataagaggaacacatatatgaccattagtttatatagagtctgtggctgctttcacactgcaatagcacagctgagtagctgtgacagagaccatatgacctacaaaaacaaaaatatttactattcagtcttgtatagaaaaatgtggccaacttataatctgtagtggagatccataacagtatcttgagtcaagcagataacaataaaacctatttatctttagcctaaaatctacagacaccagcttgattcactctataatcctaaatcatcccatgctctgctttcttcccaaaatctaccagctaatgattgtctaaacctcgtggatcacacttcctcaaagagcttttatagctaatgtactcccatggaagtaacctagattcataaattcatcaccaatgcccttggtaataaaagtagtctcttaattgacattccagtttctggactttacctactgcaacacagagctgtgtgatactaaggtgtcatgctaaaacatagattataatatgttatgtctccatttaaaactttgtgacaatataatattttaatttatttataaacgtgacagaagaaaatataaatgcctagattttgcatataaacctccctaatgtaaacacaactctttctaggttcatcttccagtgacattgtcccatatatatcttctcattctcaaacacagagcagtatatttcactgctgatctttagctcccaagcctacgtgtttccccaaacaccccagcagcacatgtttcagtgcctttgttcacactcttgacttcctctccttatttgtacgttcactcatccatccaacaagcttattaagcaatgataaacatcagacactgccctgagtaaaaggagtagagtaggcagaagacatagttcctaaccactcacacaactaagaattttagtagaattacaaaccagagctatgaatgaaaaataaagggcactgtggggttgaatcacaaaacctatgccaatctgagaagtcatagaaatcatttcccaaaggagatgacacataagccaagaaatgaagtatatgaggtgggcaaagtgaagctatctccttcatgatacttttctaattatcccaattaaaatcaacaggtttttaaatatacttaatagctgtgatataatgactaaatgtaatactatacgatcagtcaagatatgaaggctatttaatagcatgagaaatatgtggaaataactatatatatatattgttatttactctagcagtataaacactgctagaaaacaaaagttttgaaaagcttaaaggaaatttaaattctacgatgaaattgaatagtgtagtggagtttagggtggtatttttttctttcatcaattttctaaattttctgtaacataattattctataatgaataaattatggcagcttaggtaaacaagctttatataatcttaatgaaatacataagtaatgttttatgtgtacttaactattaagacactgatgaggtttggttgcatccccaaccaaatctcctattgtagttcccataatcctcatatgttgtggttgggacccagtgggaggtaactgaatcatgggggcagttaccctcatgctgttcttgtgatagtgagtgaattctcacaaggtctgatggttttataaaaggcattttccccacttcgctcagcacttcttcctgacatcatgtgaaggacgtgtttgcttccccttctgctatgattgtaagtttcctgagacctcccaggccatgctgaactgtgagtcaattaaaccactttcctttgtaaattaccctgtctcaggtatgtctttattagcagcgtgagaatgaactaatacagacatacataatactgtatactgtattacctataacacatatatctttcatgtaaaattgcaagcttctcagtcatatttatgaatcttctgccatcattcactcaataaacttcataattaaatactattttgatcttcatatttccctacttaaagactttattagtttctataataggcattaatatacttgattttctgttatgtcccatcaaacttttataaaagcatcactttcagtaaaattttgaggtttttaaagcttaaaatcaacacctataaaaaattaaaaataacaagtgtgggcaaggatgtggagaaattacaactcttatacattgctaataggaatgtaaaatgattcagctactgtggaaacagcttagcagttcctcaaatagctaaacatagaattaccaaataatacagcaattccaatccaaagtatttatccaaaagaattgaaaacaggtattcaaatacatgtacaccaatgttcacagcaacactatccacaatagccaaaaggcagaatcaccctaaatatccaccagtgaatgaatggataaatcatggtataaaactacaatggaatattattcaaccattaaaagaaacatagcactgacacatgctacaatgcatactcaaaaatattatgtaaagtgaaagccagatacggtaagtcacatattgtgtgattccactgatatgaaacatccagaacacataaatttataggcagaaaacagattggtgattgccaggggctaggggaagtgaataatggggagagactgcttaaggggtccagggttttactttggaatgatgaaaatgttttagaactagatagaggccgtactaaaagccacaattattcatagttaattttatgtgatattaagttttatcacaatttaacaaaaatcaacaccaaacaaaggagcaattttcaggaaaaatacctacaaaatgtgttagagtatgtttgctattaattgctcctggtttgtagacaccaatcagggtgcatccaacaacaacacagaatttacctataatttttactttcctccttcttactttttgctgctaaaacagaaggaaaaaaaaggtgaatcattttagcatctaggtcctgaacctattccactcccaaccaccttcattattctctgaatttttttaacctaatttacaagagtctgctattcactcagagctaaagtcatcagaggcagagttaattggaatctagatcatttaaatatttctactccccttccaaaatttccatttgcttaaaatgaaaaaagacagtttgcttgaggaggctgaaattattgcatttctgctttaaagaaatgaaaaagcattcatttatccagcaaacattcaatgcccatatgtgccaagcattcttctaggtgcttgtgatacatcagtaaatgaaacaaagagctctttagtaaaggagcttaaattccagtgggagtagggagagaataagacaacataccgaatatataagtagctaacagtatgttagaaggagataaatgacatgaaaactacaacacagtagagaaaatggggatggcgtgaggacaaaggaaaacatggcaggattaatttgggagttgagcatgggaacctcattgagaaagcgacatttgagttaagacttgaaggtggtaaggggctcatggagcacatatctggagcatgaatgttcctggcagggaaaagcccatggcaggagtatacctggcatatctggggtacatcatgaaggttgcccagtatggtagaagtgaaagaattgaaagagaggtaataggaaatgaagttggcaagccaaggagtgggagaataaaatgtttccagaagcttcagcattttccagatactgagaaaaaagggctcaactgtttgaaggtagaaagagaactacatggaatgtggaggacaggggcagaatccaggtgggctctccaatgcctggtgaaagacgtactctaagtcagtcagccacagctcccagaaggaaccaataggaattttggtaggagataaagaatgggtaaggattacaaattaaaacactcaaggataaatgatgaggacaaaaggaaggggcaatgaaatgcaaagccaaatttagagaaaaaggagaccaatgttactggagtaaacgatgtgtagagcagaaaagtaacaaggagaaaatagctagatacacaagttagacctgattgcagaaggctacaaatgccagactgagaagtcccttttctttttaatcttttcgtatgtgtgcatacaaagtatatgataaatgggatattcctcaggaccataaatctgaagatagtttgcattattgtctttaaaaaagaatatgaatagaaagagcaatttggaagctatttttttaaagaggtatttgaagaaagtatgtaataaatgaaaggctatcgctgtttctaagtgtcaagaaacaaaataaggcaaaataggagatgtaactgtgctgtataagtagtcagggttcctgacaccaaggtccattccataccaatgcataaggtccttcaagatgcacctagtatgctctcatgcctttccctccctcctgttctctaatgtctgtgaacaggatagagaggaaagaacaaaagttatgaagtcaaaaagtaaattcttgattttcaactcctttctaataatgcaaccttgacagacagagttttaacttttgagtctcaccctcttacattaaaataaggcaaaagcctaaattacaaatgtgaggactgggcaccatccctggggttattatgcaaggcactcatttttcctttaacttgtaagttacttcctttatctcattcccttttgcttctaacagctgctctggccttataaccccaatataatcaaaaataatgataaaatttgggttattatggttgtaggacatgcttattcatcaagaacacattcacaaaacaaccgtcttaataacggatacctcagagatacaaaagtggacaggggatgaccatgtcaggtggttagttgacttctctggattcaactctcttattaaataatataggtgtgtattagtccattctcacactgctataaagaactacctgagactgggtaatttataaaggaaaggggtttaattgactcatagttccataggctgtagagagggcatgactggggaggcctgaggaaatttatagtcacagcagaaggacaaaggggaagccagtacatcctatatgactgaagcaggaggaaaagggagtgaaggggaagtagctacacacttttaaacaaccagatctcatgagaactcaatcatgaggcagcactaaggggatggtgctgaaccattagaaaccacccacatgatccaatcacctcccactaggtcccatctccaacaccagaaattacaattcaacatgagatttgggtggggacatggagacaaaccatatcaaggtaataacaaatgaaataatccaacgattactcaactttagattttctggtttatggaatattctttcatatatatatatacatgtatatatatatatacatgtatatatacacacacacttttatatatatttgtatttgtatttgtacatatgtatttttatatatgaaaaattctattataaaactattactactgatatgctttggctgtgtccccaccaaaatctcatcttgaattctagctcccataatcccatcatgggagggacccagtgggaggtaatcgaatcatgggggcgggtttctcctgtgctgttgtcatgatagtgaataagtttcatgagagctgatatttttataaagggcagttcccctgcacacggtctcctgtctgccaccatgtaagacgtgcctttactcctccttcacattcctacatgattgtgaggccttcccagccatgtggaactgtaagttaattaaacttctttttctttatgaattacccagtctcgggtatatctttattagcagcatgagaagcgactaatacagtaaattggcactgcagagtgggcgctgctgtaaagatacccaaaaatgtggaagcgactttggaactggataacaggcagaggttggaacagtttggagggctcagaagaagacagaaaaatgtgggaaagtttggaccttcctagagacttggagggctcagaagacaggaagatgtgggaaagttcggaacttcctagagacttgttgaatggttttaaccaaaatgctgacagtaatattgacaataaactccaggctgaggtggtctcacatggaaatgaggaacttgttgagaactagaataaaggtgactcctgctatgttttatcaaagagactggcagcattttgcccttgccctagagttctgtggaactttgaaaatgagagagatgatttagagtatctggtggaagaaatttccaagcagcaaagcattcaagatgtgacttgggtgctgttaaaagcattcagttttattcattcagaagatatggtttcaaattggaacttatgtttaaaagggaagtagagcatagaagttcaaaaaatttgcagcctgatgatacaatagaaaagaaaactcattttctgaggagaaattcaaatcagctgcagaaatttgcataagtaatgaggagccaaatgttaatcaccaagccaatggggaaaatgtctccaaggcatgtcagaggtcttcatagcagccactcccatcataggcccggagacctagaagggaaaaatgatttcgtaggcgggccagggccttgctgctttatgcagtctcgggacttggtgccctgtgtcccagctgtagctaaaggggcaaaggtacagctcaggctgttgcatcagagggtgcaagccccaagccttggcggcttacacatggtgtcaggactgtgggtgcaaataagtcaagaactgaggtttgggaacctccacctagatttcagaggatgtatggaaatgccaggatgcccaggcagaggcatgctgcaggggcaaagccctcatggagagcctctgctagggcagtgtggaagggaaatgtggagtgggagcccccacacaaagtccccactagggcactgctgggtggagctgtgagaaggcagccactgtcctccagtccccagaatggtagatccactgacagcttgcaccatgcaccaggaaaacccacagacactcgacaccaccccatgaaagcagccaggagtagagatgtaccctgcaagaccacagaggcagagctgcccaagaccatgggaacacacctcttgcattagtgtgacctagatgtgagacatggagtcaaaggagataattttggagctttaagatttgactgcccagctggatttcagatttgcacggggcctgtagaccctttgatttggccaatttctcccatttggaatgggtgtatttacccgatgcatgtacccccattgtatctaggaagtaactaacttgcttttgattttacaggctcataggtggaaggaacttgccttgtctcagatgagattttggactgtgaacttttgagttaatgctgaaatgagttaagactttgggagactgttgggaagacatgattggttttgaaatgtgaggacgtgatatttgggagggaccaggggtggaatgatatggtttggctgtatctccacccaaatcttatcttgaattgtaactctcataatccccacgtgttgtgggagggacccagtgagaggtaatttaatcatgggggtgggtttttcccatgctgttctcataatagtgaataagtctcacaagatctgatggttttataaagatcagttccccttcacatgctctcttgcctgccaccatgtaagatgggcttttgctcctcctttgcctgtgccatgattgtgggtcctccccagccatgtggaactctgaggccattaaacctctttttctttataaatacccagtctcaggtatgtctttattagcagcatgagaacagacaattatagttaccatgcagaagctgacacaaactgccgtttttcttgctattagtactgaaaaactgccgaatctgcaaaagtatttaatgaaaacacaaacaactggtcaattttaaaatgtatttatgtatatacagatacagaagatacaaaatgaagtaaaataaaacttgggaaagtaaaatattcagaaaaagcctaactttaaaatagaaaaacataaaatctctaaagactaatacccctcatttaaaaacaaacacaattatcccattggctattttagctctcctgggttgaatcttatgctagggaaacagaaagccaaactgtcccactgtgacctgtgaaaccctgaaaaataattggttctctaatcaaaaagaaaagaagattaaaggagaaagaagagccctgcttcaggaagaatgagtctaaggtaatatgatgatagaagagtggactggaaaatgactaagccaacaattaaattaaaataaattgcttattttgtgtgaaatgtcgctgcaatagatcttttgataaatgtgatttccctcagtgataaaatttttccaattaaaataaactttatatactgtatttttaattatccatttaaatatgcaattataataacatatattttccatgttgtgataaaattatatatattcatatccattattaggtctgcgtaacatttgaactaggaaaaggtctctattgccagagtctctatcacatgaacagaaatattcaagtaaaaatatgttgtgaaacatcataaaacaagagtaacaatctgtgttttaaaataaaaactttaagataaggaaacttagtttatcaacaggcaatgtagacattgttatcttttaaaagttaataatgtataaatcttttctctagattagaactagtttctctttcaatcttaaatagtagtgagagtcacaaaaaatgtttttaaatgccaatggctctttaggtttatagaaagtatttccaggtttaaaaacatatatgaaataaaaacatatataatttaattatttcccagaaaaaaatgaagttagtagtatatattgtaaactgcaaaatatataatacactatgatacttgatgcacattaattaaatataatattttgaaaaggaaggggaaaaaatctttcctggtacttaagaaaacacaatataagaatttttcctaaaaatctagaaaggcatttttggctgtggtgacaaaaacatatgttaatgtgacttgatatagatctaaacttcaataaactttttttttttttttttttttttttgagatagagtctcgctcctgttgcccaggctggagagcaatggcacgatctcggctcactgcaacctccgcctcccgggttcaagcgattatcctgcctcagcctcccaaatacttgggattacaggcatccgccatcataccctgctaatttttgtatttttggtagagatggggttttaccatgttgaccaggctggtttcaaattcctgacctcaggtgctccacccacctcagcctcacaaagtgcggagattacaggtgtgagccactgcacccagtcttcaataaaccttttgtgaatagaataaatgatttaagaagttgagtcaaaatgccccaggactcctaaaatggccttcctataaaaggaatgcaagctaaaagaaagtgacataacacaaatatgttcatttaactgtgaaataagaaattttatggcatagagttgttccacagcctctgctgccaaagatatcaatgccctaatttctggacccagtggatattttaccccacatggaaaaaaggaactttgcacatgtgatcaaggttaaggattctgagatggggaagagcagaatggattacccaggtgggcccaatttaagcccgtgtgagtctttaaaagaaccttttgtaacttaggtcagagttagagaaggagatggaatcatggaagccaggcgagagagatctaacaaaatgacttgctcggctattgctggctttgatgatacaggaaggaggccacaagctgaggaatgtgggtggcctctagcgactggaaaaggcaaggaaacacattcttctccagagcatcaagaacatggtcctgttgattttagattagtgagacccatactggacttatatagaattagaagatgataaatttgcatttctaaagctgctaaatctgtagtaatgtgttatagcagcaatagaaaactaatacaaaggccatttgtgagcataatgattcttcctgtctctagctaagctaagctgaaattgaagggaaaactaggaaaaatagatgagaagctaacctagagttctcacatcactgggatattgaattaaccaattctaggaccaccaaccaccagacttcttgttttaatcattccctgcaggcaaatttcctcaatgattcacaagacaagactgatttatatacactaatacagaatgtaaaattctaaggtttttttccaatcacagatttggggggctataagtcatattctgagttgaataattttcacttcaagagttctgtcctcctcatctattacctgtgaagctagtagggaagtataaatattcactttcatttaagctaaaaactaaagacatttctttatgtgtttccttaataatttgtcaccagtttaggaaacaagtatttagttgaaccgtgtgaaggctgcgattgtcaaaatggtataatggcatatagttcactcaactaatttctattagcttgcaccacacaaatggaggagaaaaaaaggagtaatccattcctaaaaaattatcactcttccaaaccttctgctagcaatctatgaaactaaaaacattaagagttatcacgcctcctgcaaacccttgggagaatttagccatacgctttatctggcactcttatttgcctatcaaataaaggctctctatgccttaattcaacccagttccataattatattgagccatctctaccatcctcactaatctctgaaaatgtaaataactgtcaaaaataatgaattattagcaaaaacaagtaatattttatgagactgaatgagcttttcaagatcacccccaaagtcaccagttctatgctctaaaactgaatcacaacaagaaaagcagtttagaatctcagctttcaaatctcaaaattacaaatattattaggccccagtcccataaatgagtcatcaactgaaaggaaaaaagtcatggaaaaaaaaaatcagcaaataaaaacgagctttatatttattcctgattcaacaaatccctgtctcgagaaacttaatgaagcacttgacatttaagacatacataaaaatgaaactagatatacagaataatctattattattttctaaagttaatggtatgaactagtgttacagtagtctccataagtggctattaacataggtcagttaacacagtagtttcatgatttagaaagtttcacttgaaagcaaggctacagtgaacataggccatttaacttgttacattgtggaagattcagagatgatacacaaaactttacaagttgaaatgagttctgtattctcaacatttaagttcagctaacatttcctgagcaactacaatgagctgggcactgcaaaagatgctttacaatatgcattatataatcctcacaataacctcatgatatgggtattatgtcccccattttatagaggaaagaaactacgctgtaaaagccagggtcacacacttgtagggtggactccacaacatccctcacttcgcgtgtatattacacagcatggtgttagtatttacagctcaaatacttacagaagtgaatagaggtacgaaatgatgaaagatggttttaataaaaaatggcaagtttttaaagcctttaatatacattgtggaatgagggtgaactgctgtggggcagtggtaaggtggcagaagatgagaggaaaattattttaaatcaatgcagagcactttaaataaaacataataggatttcttttaatcagagaagcagcatggcatagcacaaagagcaatggctttagactcggatctgtattccattcagaggggctgcttcttttagctgaaattcaccgaagaatgtaactttcttatatataaatgtatacaatatctgccttgattctttcacataaatgtttctgggagcaaataaagtaacataagcaaacatttgactagtaaaaaatacatcaataatatgttgttttattattatctaattaatgagtttcatattttgtccagatttgacctaagtatacttttattaataaatgcatcagagtagtctgctaaagtgagattcaaaaatggacagtctgatgttgaaactgccttaaaacattattctaagttggatgaaatatttcattacatgtattggttctttgaattaaaaaaaagaaaaaaaggcaatataaatttaaataggcagcagttaagctgaggctcaggcccaggtctttgatgttacttcactctcaccactgcacaaattagagagtctaaattaattcttaaccttttttgccaaagaccccattgacagtcaaagaagtggaccctttctcaaaatagtatttttaaatgcataaacaaaaatacataggatttcaaaggaagtaaattatacttgaatgcagctatcaaaatgcattaaacagcagtttatgaaatagtaatacacatgtgaggaagcaatgtagatgtgctgctcagatctccatttaggaagaactttccattcagccgcaaggagtgcatttagctgacaggcttcaagttgttagcacctttagaatcctccttagcttttgagtccaggccacactcctcctgggcagcccccagccaatggctgagcctggcacaagtagtaaggactgccattaggacccaacgagggactcccctcacaggcatcatttgttccagagctccttcctggctagactggctgagaatttatcaggtttacaccatggtctaaggtttttcccgcccggtcttgcatcctgacccttaaaaaaaaacacatttacactccagcatctctgtgtctgcttccaggtggaagcaatcaacaaaatctgcttctttattaatgaattaaataacaagatctagttgcaagtctaataactaccttaattttgaaatactgatcattttaaatgatatttcaacttaactaaaataattctaatgtattttgaaagtatatgtgaattgtactcatggaaacttaataggtactgctatgtttgttacctataattgaagaaaaagctaaatttcaattagaggttaaagtatgtgggttttttttcctattcaagttcagaccccagaattctatttgcagaccccaagttaagaatcctgggataaagtgtctgattttgaaacatccattcttttaagatacagagatgcacttagacaagtgaaagctgtggttaacaaaaggtctctaacctggcttacctactcagatgccaacgcacatgtgaaagcttctattaaatgcacagaatacattataagatcatatgcccaaatgatttaaccttgagggacaagaacagcttatctaaacacatgaatgcataatcacctaaaaatctaaactgtgaaattcaagattctaaaatatataataaagttatttttatacagatttttctaagaatatactatactgtttaacatcaaaatgctacatagaatttactacttactatattataccatttatttgctatactatttatttaataccaaattgctatatagcatttaatctagcaagaagtcctctgtatctacttctgactctcctatcttgaccctattctcttcctgtgttccaaggatggtatcaggttaccattctaactctaggtgattccatctcttctagccaggcaaacagtgtatgtaatgggggggaggggaagggggagaacaggtaaatgaatagctagatttacaaatttttcttcttaaatagagacagggtctcactctatcacccaatctctacttttgtagagacaggtctcaatacattgcccaggctggtcatgaactcctggcctcaagcaatcctcctgtcttggcctcccaaagcactgagattagaggcatgagccattgtgcccagcctcaaaatattattaatgccctaagattacaatagtgcattcagaaggataagcctcatttaaatttccaggtgaataataacaagcactaatttgagccagagtcttgaatgacagaacatgatgcagacaaggcaaagaactgcctaaaatagggaagtgaactttaagcaatcggagggcaactggaattgccctggtgaaatggagagtaaggcagaagacagagaaaatggaagataaattctgagacaaaaggtgtgagataacaacaatgaaatgtaacaactttataattttgttaagggatgatagctacggacacaccactaagaacttactaccaagattaaaatatcaaggtcaacttgtaatatggaaaagcaacagtatcctccaatctaccattcgtcaagtgactccagtcaaatccattaccctagtatctttcctttctccagtagaagtaggaaaggagaaaaaagaaggaaaaagctatgtgtatgtacatacacacaccaatacacatacaccctagtttcctctctttctgtttgtaacatctgtacagtatgcaagaaacatgtctatttatagggattcaaaacagacatgttttttgtatactgtacagatgttacaatgcataaatttctaccacactataccaaagatatgctgtaactaagcatttaaccaaagcattaggtggacttgcaagtcttccttggctccaagctaaataaatccactttctttagcctctgtctttagttcccatttcgctaaagctttcaaaataaatttccatttcttccgcaccccaacagagaatatactataactggtaacaataagatcctttaatgggaagataagatattcttgacccatttcataatttctttaagtctttactacttttgagattcagccacagacaagaaccaaatgatatgtccctagagaaatatttcattctctactgactttctccccaatctttccaaatcagtatttgtgaaatattctgttcttttcaggaaactttactatctataaaacatgttgcatttattttggcatcatctctttattagcatgcattacaaaaaaacatatttctatgtgttcaccttaatgtagccttgtgaggtagtttaaaaaattttatacacatttgtttgtatagaggaataaattatgtttcaaacacaatgcaacatcttgaacaccgccaagttgctgggataatccacgtttatcacctacttcctcaattctttgtccactgaactatgatgtcagaaatctaagcttgatttgtttttaagtggataatccattaactgtttccatatgccataactattcagttgagaaataatttataaaccaatttatgggccctatctggcaaaaatgacacacctgttataaaatatgattacttcagaaagctaacaattgtggaaccacattttcataataaattagtctaagtgaattagactattcatatactttcagaaagccctttaatccctattaacagtttgtgaataatgaaagtagttaatattaattttacttgacaaatccaacaccaataacctgttagtatactctaatccattttccaacagcctgtaaaaattaaccaacagatgcttccaatctggtaaaaaaaaaaaaaaaaatacataggtcattagcattattttgatgataccaaatgttcaatatatgaatattatgattaaatttcagagagatagataaacaatctttttttataaccttgttaagtcttaacagaagctgaatttagtaaaatgtcagtcttttctaaaatcaaaatcagcatttgttattccactccttgttattatgcttcaactaagtacttgactgagtttcatcaggaatgtaaaagcaacatgagtatgggaagcacacctgccttattcatgctggtatccccaatgtcaagcatgaggcacaacatgcaatatgcacccaataaatagttattgagtggaacagtggtagccaataagaaaaagtggaaggtatgaaagaggaggtatgagaaaaagaaaaaacataatctggaaaagtgcttatatacatttccagaataatttaaaatacagaaagctaagatgtctcccaaaaacttacaacagagagaatcaagaaaactgaagtgagctacttaacagcaaaataaagtgtaaaagaaaatgatgtaagtgaatcaggaaaaaattactgatttttcacaggaaaaggattagagaggattcctattcctctacagatatggcacaaggtactttcccacagaagcgttgttgtaaatggtcacaaagattagtttaaaaagcagaataggtaagatctaattggaaaaaaaaaagtaggaatgtaataaaaggcaacaggaattaagaggaaagagccaagcccttaccaagaatatcttggtaatatgtaaatgtaggtagggttggatagtatcacaagaagccagaattgttttgccatcaggagaccaggagaaaagatctcagctgagatacactaaagattaaacaagataatatgaagagaacccagctgaggcactgatatatcacgtatgcacaatatctgatatagatattagctccttttccaactctaagtgtattagacctgtaaatcccagtagtctaaacattagaagtcctgaaaacctaaagtagtgtctaccataagaaaaaagccccacttacttgacaacaaataaagtctacatgacagaaaacttcaaggatctctttaaatgattggattcagttcctttgttcttactacccaatttgaatgcttgggaagcacaaaggattggcatctatcatttaaatgcctgggatggaatgtccatctttgtaatcaaagaaatagcctcggttctcagtccaaacagttactactgcaatgaaaaacagagatacaccatttctctaaaaaacccactattcttcagtaattaccatccttccctacctagttgtgatgaaaatcagccagcagccaatgcctctacctcctgcactggcttgcgaaagggtggaaagacaaatggattttcaccttggagtgaacaatacataagtgaccaggtttacttttgtttgggggtttgcctgtttttgtttttttgtttttttgtgtttttttgagacatagtcttactctgttgcccagactggagtgcagtggcgtgatcctggctcgctgcaacctctgcctcccaggttcaagcgattctcatgcctcagcctccggagtagctgggactacaggtgtgcaccaccatgcctggctatttttttttttaattttttttagtagaaatgagggtctcatcatgttggccaggctggtctcaaactcctggcctcaagtgatcaacccacctcgacctcccaaaatgctgagattacaggcgggagccattgcacccggccatagttttgaattctgcagcaattacaaaattgattcaaacaaagtatgttggactcagggagatacgtgaatgtaacatttggacccaatgcctcagcagccaggccatgaataaaagaccacaagtagacctgtctacttgaccagtcctgtctaagctctctggacatctttctctttccttcctttctgatctttcctattaaatgtctatataaaatcctgtttctctgaacgtagcaatgactggcctttcctataaaatactctgaagtgttttacatgtaaatacacattttaattgtcatatattctccttgattgccagatgaccagtaatgccaaaaagcactcttaggactcctcaaataatgctttctaggaattattctttaaaatgaagtcccaaaaaaatagtcacctttacagctcatctctgcttaccactgagaaatgttagcagggctcggagtcacaaccctgggcttccccactctttgtgttccccctggaaatgtcatctactgtcacagaaaaaaaagaaagcagcatttgagttgaattgagacagaaggtatcatagtcctctgccagcctctaagtcaagtaaagagattccaggccaaaggaccagcagtacaaaggcagagagagatggaaatatggagtatgcaaaaaatgatcaccttttcaccttaatctttctaactagtattagatagagcaaatacatcatttttttattcaaccttgaatctcaaggctaaagttagatgacttaagaattttttaaaggtccaattatttcatttagggctaacattgcagctaaattaaagacatgctaacaagtttcccttttgagcctcattaattaagaaagtaatcagagtaaggagaaaaagagagtagctgtatggcagaattacttaaatagtttttaggtaccaccatttgtacctactaggaaagcaaaaggaaaactaatcaactccagattatgaaatctgaaattctgaagtgttttacatgtaaacacaaattttaactgccatgtattttccttgattgccagaagagtacactaatcttatttgaagaaaattttgatcctccataatcaaaaggtaaaattaaaatcttattcacaaatttactagggtgagcttgctgagaaaattctccctgtgttcaaagaccaaaaatataccatttttaatactttagtcaggataaatggtactcaaaaatatctgttaactgtttttatcaaattctagaaaactaccttaatttacaattaccttttggagagagtttctaatttacattaataatttcttaatttacaattaccttttagaaagagattctaatctttcagaaactcattcaaaggaatactaatacatttttaaaatatctgccagcattctttggctgctgtgctcaagttaaacagatacataaagcatctagcatggtgcctggctaacagtcaacatttaggaagtcaactcaaccctctacacaaaggtctctgacctgtatccatccagtacaatctctccctgccacctcttcctttgttctatgagcccagggatataggtggcataagtctatagtgaaaaatttctttttgaaaattaaaaggtaatgattgatctaagtgttttgcactacagacctaaaatgtaagttttatataatacttaaaaattctgtgtggatatcagccttgaaatgtaagtagcaggcccacgaaattggatgaaataagttcaattttcacttatgtaatacctaaacaattttttaaaaatcacactgcacaggtaaaacctatcacaaaacattttggaaaatgaatgccattgcttttaatgaaaagatcatataacctactcagatacttctctttcaagctaactttgaagacattataaatctgatatttttatcccatgtgactcatagcaattaattaaattatgtgatagtcactgtaattttttttggattatactttaagttctgggatacatgtgcagaacatgcaggtttgttacataggtatacacatgccatggtggtttgctgcacccatcaacccgtcatctacgttgggtatttctcctaatgctatatgctatccctctcctagctcccctagtcactgtaatattaaagggtagtaaaattctaactacaagaaagcacacattttgtttttctatttttcaaactgaaggaccttctcatgccaaaactgtcacagaaaatatcctcttttacaaaagtctaatttatcccaatggaatatcttcaaaaataatatcatatagaaaatttaataatcaaaattttatattaaccttttgcatttttaaaacagaatttactttttaagcactttatttcattataccatttatttgcccattaggaatgtaaaaataacatgtacaggattcataaaataatgttttctgaaaattgatacataaaaagtatatgttaaaattctaaaatcaaattaataaataatcaagatgttaaacttacctttttgttggcaacaaaatgtattctcaagtttacaaagcaaatccacgttttcatacttattttcatttacttttatccagaaacagttttcagtcatttcatgaggtctgatctacaatcagagagaagactgattcatcaataggtgagtgtttcacctgtcccaagtcaagcactatgcatacactgagtatcatagctgtcagcagatatttataaagtcgtatctgtaagatttttccctgaagtgtgttcaataagatacaagttctgcaggatgttaaggtcttattaggaagaaaaggcttccatgatccaatagttgaggatttgaaatacgatttaattagcttcttctcaattgcatttctcatagtctctaataatcttcacctgcactatacattttggtgggcaggacacattatacagcattttccatgtttctgttaccatgaaaccatttttctgcaggattctgaattcttaagatctgactagatattagcttctgacaactagttaacactttcccaacatctatcaatagagaaaatttcctaagaacaccatcatttttttttgagaaacacttcataaacataggattcactgcaataatgtttaattatcaatttaattacaaatcggattccactggaacaacatcaactctcactgtatttataaagcagaaagtcttagtcaatatgaaagggatttgtcccaatactttaaaaaaaaagctattttattgtcactttgattagtgacattagaaattatgtatatataaattaaattatgtaggcataaattaaatctcattagaaattatgtatatataaatccaaaattagatttagatctaagtaaaagtattttcctctattaatttcttttacctttaaccaattcaatcttctcatgctgatttcaggtttaaattctttctttggtttcaacccaaatggcaggattggtagaggaggagaattttgtcctccaaggaatcccaggggaggtggtggaggcacaggaccactgaatggcatccgcattcctggaagtggaggaggtggtgggggaggaggtggaggcggcacccctccaccagaaggcagtggaggcggaggaggaagtgctgagtggccagttccaccttctttagagggaggcaaaggaatattacaatcagctggcaaggcaccaaactggagaaaaaaacaataagagacataactaagaacatatctacaaaacatgtaaatatgcactttactcaaaaataaggcattcatttaaaccaaaaataattacatatcagtaatttcataaggtttaaccaaaaatcaaaattccaacaatttttcttctaatttaagaatataattatagctttttttccctcataaaaacataattgccagaagtataattccctgttttgaggtagttatgaccatctaggtagaaatgtccaggagggaaatgggtatgtggatctagaagatttgaaaatcagtagtctctggagaacagttgaagccagggaagcagagaagttcactcatagtatggagagaatatgtagcatgacaaagggtctatgcacagagttctatggagtgcaagcatttaagtgataagtaagaaataagatttcaacaaaagaacttaaatggtattgccacatcatgactttgctcaaatcttctcaatggtgtcctaatgcacttgagaaaacaacaacaacaacaaactaaaattcttcgtaggacctatataagtatatcatgatctagtccctgctatctggtcttgtaggggactttcttctaattctgtgtatgtgccaacctcatgctaatttcagggcccttgtacatgctggtccctctgcctggaacattctcttcacctgaccatctcctactagcctcttcagtctgagctaacaggtcccttccttgggaaagccttatctgaccactcattttacactgatagcaccttgtacttttcaatagctcttatcaaaagtgagaatttatttaaggaatcattagcatttatctctttgacagatcataagctgatgaggtaagtgactatcttgtattatttactgctctttccccagcacctaaagcagtgactggtgcatgacagctatggaagaaatgcgtaggataaatgcatgaaagacaagaagagaaaaagccaactgggcacagggtcaaaaactatgaatgaagagagcaccacctaaaagactgctttgcagaatcaaatgccacagagaagcaaggtaaaatcaggggtgaaaaaagaaccgcctgtgtccactggtcacttttgtcctcatgtttccatggcataataagaatttaacagatgcatttcgatggatacaaagaagacattctgggttaataaataacttttgtaatatgagtagcttcttgaaattacaaacttcaattctaactacctttaacatttaataaatgttacataattttgaattttcatggcacaattatgaaaaatagaccatgtataaaagctcgaaatcaatgacgtctgaaatcatgacaaagaaaacagtgttataaaagaagttgaggccacaaatcaaaagcatgccttatcaaaaccattaagtataaagaagaaccagttcagtgttactctgggttgctgtgatcaaagatgatacttccttttgaacgtatttaataattaactatcaatgtcttaaagatatggctgaatttctgctctagaatagttcatttgataaagtgtgaagactgacttaaagatatggtttgggaggccagacactgtgactatcttgctcatcactatgtctctccagcacctaaactacctggttgtgaagagactacgggagcaaaggaattaaatcacagataacagaacatattttattcatactcttcatagtcagcatagctttgaacaaaaagaaggatcttaagataaatgcccacatttcataagaaataaaccagaatccaaagaaagaatttgccagttgttcaaacatgaatatggtggccaatattaagtatctaattctaggttttcttctcatagccataaacatgggtcatcactgtatacaatttaaaacaatttaggagattccttgatttaatttcactttcaaaacatacacttattcccattttatgtaaaagcactatgcagcaataacttattcaaaaatggtggatacgttttttataaactggaattttctggagatttacaaacaaaccttcaactgaacataattaaaaagaaaagaaagttcttaaatttacgttaccccagaccaagaaaaacttgttataaatatttcagccactgtctgtaactcagtctgaagtacagacacaatcaaatgtttctttcaatatgagagacaaggaaccatatgggaaagataaaaaaaaaaattcaataaaatgtgatacttccctcttgcagcactaaagaaagaagatgaatgagaataattttcttgtagataggagattttaatttttttctaaaattgaatactaacagatagctatctcttaaggtatctccagacagcctcagcaacaaaactatccactaagcatttaaaagaaaacaaaattgccagtaagataggatatagtatacctgagactatttcaacataactgtaaattaagatgaaaggaaaatagcaaaactatacttattgctcatcatcctgtacgtaaatctacatgaagaaatttagctatgaatattctacctccttacttacatccacataaagcatgcagatgacgtatttcttgctatctaaatgttttatgtgtagagggtgcatgggagctatctgcttcataatccagatttactctcttttttgtcatgttttaaatctgtttactttggaaattgaaaaattatcagaaaatgttctcattcagctagaggttatcttttactgcaagggacccctaggctgaaggttttaaaaaataaatagcttgagcaataatttcttgtagtgggataaagatcagtgatgaataacaaatctgagagtaaaagattttcttactctttatgctgaattacttaggaaacatgtgacattaggaacaaaaccctaacaaaacataagaaagcagattaattagtaaaagcttagatatacatacatatagaaaaaaatgacaaaaaaatagcaaaacacagtacaaataatgctataaaaatatacaagcaaaattaaagtttaaacattttgatgctatgaagatataacataacctttgctccctcactgtgtttttaatacccaaattcactcagagtggaattttacctgagacttaaaagcttgtagctctgcttgaagctcattaatctttgcctcttttttctgcaattcagcctgagtttcttggtggtcggtaaactctttttcaaactgaaacaaattaaaaataataacaaaaacaggaagatgaaaatgaaaagcactattcttcttatagaaatgtgactcgaatgatctgccggtagaacacaaattcctgaattggttttatgaaaggagtgatagagttttgaaaagtcacttacagtctttctctaggcccctccaggtcccaaccaaaatcgttcattcacaagggggcagaaaaaagccatagacaagtctgtgaccttctctctgcagagcaaactggccacagttatctgcagcattggcatttttcttcaaagtctctaaatattattgtgactttgtgtaaaataatagagagcaaagcattgtacaaattccttgcatcttccacctgcaaaaacttattcttgaaacttatctgaagtatatcaacatgatttagaggatttcattttaatattttttattactaaacaactccattctattcagtttctaactttttttcttgtaacaacataatatctcctgatatctttgggaaagtaatgataaattaatttttcaaagtccctagtgaaataccttctggaaaaaaaaggaaacaataaaatttggtgaatccagtgaattttctataataatttatatatccactcatcaccagttctcatcttgcattcaaacacattcaactttgccattattatgactaaaaacctcctttttgctcacaaacacaagcatttgactttcttaagaaaaatgaaaaaaaaaatcaatcaaaaaaatgcaactatctcacaaatgtggcctccacattttaaatacactcaaaccttaattaggaaaataacaacaatgtagaactccaccgtttacaaagggattttatttttacttagtttataaagggaatcttactttgtccttaataacactaagaggcagttgctagtccctcatagctagtaaaagatgtgagattaaaaagccagattccccgccttcagagtctaagttcaaatgaaactatgccacctccctgcaattaacgtttagataatgctttacggttttacttaacagactattttttggagcagttttaggttcacggcaaaactgagcagaaaatagagattttccacatacccccaaccctacacatgcattctctctccccatactttatagcttttgaagcataaaaagaagcattcttaaatttcattacaaaaactctgtgaaataagaaatactgctttaattcccattttacagggaaggaaggtaaatttcagactactgattctctcagtctcaacctgtgttcctttattaaaataacaaaaactaataggtaaaaactgtccaaatgtccttcagttgacgtaagccacagcaacactaccattccccacaactactacggctcctacaaacccctcttaccgttaaataattaaaaagattctaagcctatatctaatcaaattactaactacaaaacaagccatgcatgagtctcagaggtccgcccaccttctcctgtcacccagtgcttccccctaaggacttgctaaatcaattgccttcacacctcccttgcatagtttacctctctgtactttcatccctcattttactccttataaccccttaccataatccctctttagcttaaaagtcaactttttcaaagggtattcttaaaccacactcacttttctgacctgttgaactctgttcatttcattatctatcacacttagctataattcattctaaaaacgctgacttaccaaattccaattccagaagtccaaattccctggactgctctcagcctcatcttaggtgatctctctagggccatgctatttcaatatcatagccactgaccacaaatgattatgtaaatgtaaacttaaattatcaaaaataaataaagtttaaaaattcagttcctcggtcacaccagccattttaaaaagtacactatgggcacatatggctgatgactaccatgcagaacaatatagattataaaacatttccaccatcccatattagacaggccagttctatagcataaatacctacaaataggcctccatattcaacctcttttcctgtatgttccattacaacacacacttctggttctcctgctactccttgagtgctcctaccaattcctgttatgggtttctacaaaatccaacccactaatgatggcattctataggactctttcctcaccctcctcctgcttgtctcatcttccacagccatgtttaaatcaccatgcatacactgatggcttacaaatccctatcaacatctcagcttctcatctgaattccagactacaaatcagtccatgaatatatttccaaccacttaatgaaaacttttcaagacagacgaaaaaacatattttcaaaaccaaacatgtttccccctacaagatttgttttttgaatgttgctattctttgtaaagggcagctcaactaacatgacttctttgttcttaaactatcagtgacttcattataatcattactatctaagaaccctgtaggatctggccctaatctacctatttcccattacgcaataaatatttaacaacacacccgagatatgccccctcagagtggtaggttctgaagacacagttaaacagaatatggtcagtgtacttttagtcagcacagtggctgatggagaagtaaaagcaaactaacaaccctaaatcaattaaaaataccagcaataaagagagagacagagagagactgaaagctggggaatgattcctggaggaatgatgtttgacctcaaagtctgaaaaacttactagcatttcagcgtgtggatgaatgacaagcaatactttgtaaggggcacaaaaagaggtatgagaacaaactgaaggggataaagccagagatgaacacagaaataaaactgctgaaaggaattttgcaataagccaaagagttaatcctcttttcctaaaaatcctggagcattattaggtatgtataataagtaaacaacataatcaaatttttactttcaaaaactcaaccagcagcagtgtgaaagatgggctgaaaaagacatactagaggcatggaaattggtttggaggctattgtagttatccaagcgagaactgaaggccttcctgaattgaggtggaggagagggtaatgacaaagaaatgaaaaaagactacagaatccaaaaatgttagtatctgaccgaatgaaggaaatgagcgagaggagtgtatctaagatgactacagggttttgttgttttacaagctagaaaaaaagtgttgttatttggggaaaataaataaggttataaaatgcagggggaaaagatatttttagggagaagaaagataaatttggtttggatatgctcagcttgagataggtataggaaattcaaaagaaatttagatatgcatccttcttggctatctcgcgttgttcttcatactgattcctcaaggctcagattagacatcacttccttggagaaggcttccctggccacccatgactaggtgagggacctttcctctaggtttacataccacatagggtttgtctaccataccaattgcacactgtaatataaaattgtcaaaataacactcaccaacctgaaagctcataaatgtgagaaacttttctattttattcatcacctttccagtgtcttacatctataattaaagtcaaataaatatttgttgaacgaagtgatgagccaacctcgtcaaatcttcctttatatgttgaatgactatgtcaacatagtcactctcccagcatcagaaatctttgagaggtcattttctctttttgacaactaagacaaagttcactgttacacagcaagaaaaaaaattacgttcttatgagagtaagaatgaaaaagcctttctacaatatcaatatgtgaattatgaaatatctatttcataaatcctagactaaaattcataaggaaaaagaattatttcgggacttaagataaaaattataaaaacaaccacagtcataatgagtacattctaagaacatttattaaattaacttgctaatactaaagtaactgtattacttatgaaaaaataagtttccacatcctcgcctataaaaagatagctgaaatataaactttgttttagcatttttgtaatatctatagtcaaatcactgtagccttggggaaaaaatgaatctccattaaaagcacaccttataaaaactgatatgatagccttctccaaaaagagttactagagcgatattacacttacaaaattacatgcaaaaaaatgttgaaagacacagttaaggttgaggctctgcttaatttcattctctagggtgaatgtattagtgcatctgtacaagaaggttgataattcaatattctctatatactttctgacatttctggtcttcatttttcaaatttatgcaccaaaataaagaatgtgtctagcaaccatgatagcttcctgcctaaagcaaagtatttacatgtgtccttataaaactatcagaacaaagtttttgctgatatatacaaaatgatatggcaatagaaatattttatggagcaaatagtattttctgaatctaactaacacatataatttctgactaaaaggagacaagtaaccttgaacaaggtctttcttctatttatatatttaaaacctacaatttgtttaaaaatctgttgagaaactttaactccattcatgtttgactccattcatatatactatatacctaaaaatgataacaaaatcaaatttatactatctgggatgtatccaaatcaagtacttgaaagtctactactactttcctatgaagagttaaagtgcttatccagcttagaatacaatgttggctgggggaagggtcaccccacaacatgaacatctatccactgtaacactatgagactaaatttaaatgatccattaatttgtttcccccactaaactaagtcacttcagagcaacaacaatattatattcacaactgtaatcctaacctgcagccgaaggcgtgggaaataacaacctctcatttagcgtttggtaaagtcagaaccttaaggccccttaggacatttataatgttttacctaagttactcttaacttacaaaacagtgcctataatttgtaagttatgttttatcttcaaagctatagaaatgtgcaactgcctcaagatacatttagtatctgctacatcaaaaacctatactccttggcatgatgcctaacacacaggaaatattcacttcgtaaatgtttgctgtgggttcatcatggtgacaacagtagtaagaattatcgtcactccttcaatgtgaaaaaccacctgaataattcaaatcagattgactatttaaaatgcaaagaattggaataacaaattaaaagtctaataggtacttgctaagccagagataaaaggacaaaacaataccttaaatttatgcctactgttccattattggaacgctgagcatgtggaagttatttatatcctactgcttaaggtcactgccaatgtctgatttttcaaaactcaaaaaaattgcaatctcaggcataaatgggttaaagaaaagtaaggaattggctggatggttagaaatactactgagttgaaacaaaactggttttgtttgtgtaatatccaacagctatgacctatgaaaatggcaattttataaagttcaacttaatataatgaagcaactttaatcaaaactaaaagcaagttaacttttctcttaaaatttttatatatgatttcattcttaagggcttaatatcatttcttgagaattaccacaaccttaaaattttgattacatacattttgctccatcatccactcattcaaaaaggatctttttagttcttacaaagggccaggaattgttcctggtgcagggatagtgaataaaacaaacaaaatgcctcaaagtttactgttagggtgaaatagataagtcattcacatataaatacataaactatgtagcatgtgagatgatgataaatacattcaaagaaaaataaggaaagaagaatagggaaggtcaaggttgggagtggggagttaagactttttagatacagtagtcctccttggtggagggcatctatgcacacacctgaagcagataaagaagaaagaacgaataacaagcaaattccctgaggcagaagcatgcctgcagtggttccccacagaatactataaagttagtgaaaactacttactttcttgtaaagttctgatgctttctcttcaaactcttctagttttgcttgatctatgcaaatgtctaaaattgcaatgacaggaaatttttaatgtgaaacttcttaaactcattatgacttcaaaagtttagaaagaaaaaagatcatagaaaataattaaatactgatactaccagtaataaacaaaatggaaaaaatattataatgttggaatgaaaaaggcttttctaagcatgataccagaaaacagaaaacacaggaaaagccaaactcaataacaattttaaacttctagcaggcaaaaggagatgttcaattgtaataacactcaaatgtttctatcaccaactcgtacatattttaaagaaaaaagatgatgtctataaacaagcttaaaaaaaacagccaacagtaataaacagaaaattagaaaaattgatactaaaaaatcaccaaaacagatgaataaatgtttattattccctaacaatatgaaaattagcaatatgaatgtgaagattaaatgactgataatgccaagtgttggagttgacatgaggaaaccaatagtgaaagctaagaactttgctgatgaaaaactaggcaatatatactaaaattgtaaatatggattttcttttaacctagcaattccatttctgagacttggccattaggcctgaaaactcattaaaatattttttgatgttagacaaaaaaaaaaaaaactgaaaataacttaaatgcccatcaataatgaactgcttaaataagttatgatatatatacatgatagaatacaatgtagaagtaattcatatggatttcccatatgttatcccttcttttttattaaatgaaagcgatacatgaacaaagtttataaaaatatattacagaagaatttataataaaaaataagtcaacaaagttactgtatccaaatcttaatcacacttcctaaatgcaacctcttattaccatttctatactagattattttggtggttagtttcttaactgtaaataaaatgtacataagtattatttcttgatttatctatttaagacattatagataactttctattataaaagattaagacagtatttgttctctaatcctaatttttgatattttatttactaaactggattgctccagagcatgaaatatttaattttgattcccattacattaagaataacttaaaattcttgccacagtatgtcaaattatctgtgcctcatgctttccaataccttttctcccctattgcccacctttggttcttctctcacctattcatagaaatacaatgacattctcttctgtatttaaatcttttgtatttacttatgagattattctaaatatttaaaaatcagtaaatacaattaatttattaaaactacataagcacgcatcacttatacaaccaaatggtgttcaaatattttatttccttctcaagagctcagtgaaaaaaacctctcagctgccattcctaaatgacccagtggaatacattttttcagatactattcaaaatcattccacattttagtttgctgcatatttacagcaccattttcttaatttctgcttcctcttcccactccccccaccccaggaacttctaattgcttatctcttatagagagaaacaagcattttcattaatattatctagttcttcactaattatatttcattcttctcccaggactcagataatatacgaaaagaaacataaccctgcacagatacatagctgaaaatgagaggtgtattttaatagccttttcaaatcattgtgggtaatcttctttgatgttatatcgaaatctgacaaatggtgacttcttaaacagtagttacaatgtggaatcacatatcatatcaattaacttgtactctgttaccctaaaatctcttgataaatgttgcacttttaatagatcttttgcctatgcagaatttgtaatatcaggcactggtcatatggaaagaatggtgtgctgagtcatgcaaatgttccgaacgttaacaggtctttatacaatatcacaatgaataatcagataggttaataacaccagtgacatcaggaaataattttagtattgagaacctgtcagcctaaaagcagcagatacaagttttccaaaattcaaatttccacttaaaaactcaaattttctcattggcagcctatttatcggccattttctttgaagttataggctcactttatttcatttttaagaaagcaagtgcctgacgaaaactttaataaaaactcaaatgttacaacactaaataataatgctttatctttaaaaaaaaaaaaaaaaaaaactctcaagttatagaagccatcgtctgtatgagtcattccaagtttaaaaaaaaaaaaaaaaaggcttcgggggggacaggcaattctgcttgcaactcaattacacaaatattttcttattgaactcttttaatagatctttgcctatggagaatttgtaacatcaggcactggtcatatgcagcagaagtactgtatgtataaatcccatttgttaacacagaatattaaaacagtgtgtatacaagggtcaggctttaataaagttaacatttttaggaccttatcaaaggcattcttaagtaaaaaatggcagtttttgttgttttattgacagtaaagatgataatgactactcccacagtttagtgccactgccttgattcataacaaagtgccaggagttttactcaccattgttctgcaccaccagtgcaaaataccaacccaataaaaaaggcgaataatgtttttgtgctattatgaaaacagttttgacaattagggccctcaggagtccagagacacaacccgagaaccaatgccctagagctcattcatagaataagagacaataagatatttctatttaaataataaatactcacctacaaactgggttaaatctaaatctagtctttttcgatatgtgaagtctggatccattccatctctatgcaatacaatctgggatacacactcatcaattaatttgaagtattgttgcctaaaaccaaagaaaagagtaaatgtacaattgataattagtgtaactttacatcaaaacaaaactttttggctaagattgatttcaagttcaacaatttattagtaatataatttcaatagttgacacaacagattttacctgggagtgagagtaaatacaattgtcatcactttgcttttaatgaattcaaaacatcatttttatagtcttttaggaaatacagtatcccttaattttcttataaaagtcaaaaccttgaattaagtaaattagctgaaagtgaagtgataagtgcttaaaatttgtgctcagaggtcatcaactttccactgtaccacactgaaatagctatcattaattcacttcattaatacaaccaaaataaacaaaaattttctctaaaaagttttatgggagtatgtggtatactgttttccaagtgtttgtgaaatcaaatttaaaactggtactgtaagttatatataatatcaaattcatatttcttactcaaagggaaatagaaaaattcagtataataatatttgtccaaaaatcgaagtttaactaaaacctccaagtagatttcatgttgtcattacagttaagtctagtccatctacactggtcataggtgaaacatcccttaagattttgaaaggatcaacaaaattgatagatcgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttcaatctctgaatagaccaataacaggagctgaaattggggcaataatcaatagtttaccaaccaaaaagagtccaggaccagatggattcacagccgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggctcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtattggaagttctggccagggcaatcaggcaggagaaggaaataaagggtattcaattaggaaaagaggaagtcaaattgtccctgtgtgcagacgacatgattgtttatctagaaaaccccatcgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaaaagaataaaatacctaggaatccaacttacaagggatgtgaaggacctcttcaaggagaactacaaaccactgctcaaggaaataaaagaggatacaaacaactggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaatggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgttggagaggatgtggagaaataggaacacttttacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacgtgtatgtttattgcggcattattcacgatagcaaagacttggaaccaacccaaatgtccaacaatgatagactggattaagaaaatgtggcacatatacaccatggaatactatgcagccataaaaaatgatgagttcaagtcctttgtagggacatggatgaaattggaaatcatcattctcagtaaactatcgcaagaacgaaaaaccaaacaccgcatattctcactcataggtgggaactgaacaatgagatcacatggacacatgaaggggaatatcacactctggggactgtggtggggtggggggagtggggagggatagcatttggagatatacctaaggctagatgacgagttagtgggtgcagcgcaccagcatggcacatgtatacatatgtaactaacctgcacaatgtgcacatgtaccctaaaacttaaagtataataaaaaaaaaaaaaagaaaaaaaaaaaagaccaaaccaaaaaaaaaaaaagttatttgagattagttgagcatgagtaggtatttattgctttctttttggccagaaacttgttagtgaaataaggctaatggtagaaatatttcctcttgtaaagcataatcatctcttcttgagaagactggttttaaaatatcctagtgcttttagatattgtacctttttggttatgccaaatattagttcactttggaaagccggtaatatgaaaaatgatgtcactcatcattagtacagaggattaaagagaaaactggaacaagaaagatgtctcagaaagggacaaaaaaaaaaagatttaataaatgtaaataaaacagataaaagattttataagcaaaaccaaactaaagtgataaacaggttgggtactattctaatgaagcacagtcctccatctcagatcatcccctagaacttctttccttaatgacttttaacatacttttcctctctaaattctaaagtgtgggtccctcaagccatttagactttcctttccataaactatgacccactgctcttgacctacttaccttacacctaataaaccatctattacagtgaagaaaatccactacagcttaacactagcaaagatgactaatgatcattaactgtcatagagtgaaaatgtttaagaaacggttcctgggtacaaatcaaaagtgttaatctatgcttgcctctatttgttcaagttctttcaagacattatctcccatccccaaatatttctgccataataaccacatttacacgtggtacatacatttaaacacatttacatctattacatttaaaaatctagatgatgtatttcttttctactcaacattattctaatgtttttaaaatgaaaatgttttaaattaacaacacaagctatttcatgtcatctttttaagaaatcataattttagtaagtttttcctcaactccacaatgtccaattatgagttcatctataatgtggctgaaatttcatgcaaaaactcactggggaggcaatactatcaaagaataatacacaacatttctggattccagaaatgtcaatctagaaaataatctccatgagcaatattggtgaggtagtaaatgtgtctgaggaatatgtgaataacttaattaagggatgaacattaagttgtcattactgacaaaatgctatttttgttggaggagtttttgaaatcttcacttttctctgtggtattgttaacaaatatcagaaattatctcccatgcgcatttaactagcgtggtattttacacatggtaagccttaattatttggtgtaaaactgaatttgatcttctccacccaattatcttgctgtatttcagccccctccctttttcccagggaaaaggggctgcctttgacatatattctccaatcgaattccatttctgtcaaactttcttttgtcccaaaagtggaaatgaaaaaagattctaatttttccatccaccaattctttcaaatgagaacatttaacattctgcaatagaacaatctactgtttgtaaaaagaaaaagaaaaattatgtgtgttcgtatcaaaagtagtttaaagagctcattaaacaaaaaatgttacaggttatctaagattgctgaaaaggtaaaatagaggtccttctgaggtagatgaaaccaaaaaatgaaggtaaaaaccaaaaaaacaacactcatagacgtgtacaccaacaagagtaagttttactgtatgtaaataaataaaattttaaaaaataaatgcatgacaaaaatatatgtaaattatcacaattctgacacaatcttggaataaaagcatattttaagaaatatttttaagaatttttttaagaaatttttttaaagaaatattaacaacaacaataataaataggagagtttggaaacatgaggaaaaaactgatggagttgtcttgagtctagcagtcacaggaagaacactgcctttgtggcaaccatatctggaatcaagatacccggggtttaaagagccaaagaaggaattaacataggtgaacatcaaatgtaaaagttcatactcaaaagatggccaaatatctaaatttctatgccttaatgtcattttggtaatgccacaatttaatctttctccaagactcttgatttaactcaaatgatagtatcacctgaacataacccaaaacagttgtgttttttaatctgttttgaagctagatacaaccacatgctctcttggggcacagatgaagggatcaaagtcataagtatgataaaacccctgcaggactacaggcatgttcaaaccattgaaaacaaacaacagtcttaaattcttgggtactcaaacagcatcaaacttccagaagacgacaggactgaccacacacagatcaaaaaatgtatggagtttactttagagtaaatagaagtttcaatgtcatttttaagtaaatttggagtagaaatatagtatcataaacagcatggtacaaatgatattttaaaaatctaaattagcaattcttaatctagcatttataatataaatatttaaactggtttatttttaataaaatatcagaaaggagcaaattaaaaaaatcagttactaaactcatattttagaatatcagtgggatttctggctacaaagagagtaattttgatgcatgtcctatcctcatcctgaaaaacctaaagttttaacattttgggtctcctccttgcttgttaggtacatcaaaaaatcactgagtcataccctctgatgttaccccgaggacacagcctgaatgaagcttgtctaaaaaactcttctacttgaaattaagtagaaaagaaaaaaacacccaaagtataagagaatgaaatttcagcaaacctaaattggtggcaacaaaatgattttatattcaaagagctcagcttccaccataaaacagtaatagaaatggaaagtagatatagagaacatttactaagcatacaccatatgccaagggtttggctagaacttttacccacattcccatatttcatctgcctaacaacccagtgagttaggcactaatctccatatttagtcacattataatgtagatgaggttaaaagaaagataaataatttgttaacctcagatggctaggatataatcaatctttaaaagccatttgtctggctttttgatatattagcaacattaaacgcaactgtattattaagacttgccagctacttaaacactaataaaagcaatgtttagtgcccttcatgtaacttataagaagaaacttatcaacatcattcctactgcctaagaaataactagaaaatattatctgtcacatgataaactagtaatttgttgctagtttgcatttttattcagatgaaaggttgtaaccaggaatccacaggagcttaaaaagtaatagtaatatcattttaccatcgtctacctaaatatatgcccagagaaaacaacacattctatgaatcagtgttatgacaaaaataaaaatcatttgcttgtcaaaggcaaatatgatgtgaatttcacaattaatagatttttattagtgaaagaaaacattagaatacaacttcctcttaccttataaaataatcatttcgaatcagcaaaagatgctgaagaatagaaataaaatatccctctgctctagtttctttaactgtgctccacaccatgttgtaaacatcatatgcttcagtgagttgattaaggaatatatggatttatttatactctacaccaaacaactataataatatgacagaatttgtcctgtaaggttttggaactgtaatacaggcatcttatatattcaacataaaatacagatatttaggattgagggtagtggaaaaactctggaaatggtgacttaacctgacacttcctgacttcccttctacaatcagttccaactaatctgtctcccctaagcacagatgctgttgggaacaaaggtagtagggaagctggctatgaatactgtgttgaattctaaaggttgcctgaccaacagagctggtggtcaggttaattatctaccatgaagaagccccaggtgaggataggaacctgttgggtctcatgaggagcacagacgtctgcagacccacagattaacatgcgacccatgagtatgcacccaagatgcagggaaagagcagccagtgactaaggctgccctattcctaatgctaaaaagccctaagtagaaggaaaagtgtcaaatataaaaagaaaacaaaatagattgcacacatacatataagaaaccaatctacagaatccatttgttagttgcagcatacgcttacatatatgtgtattcataaaaacacacaaattaataaaataataacattcttctgatgcatgaaggtttgatttcatgttgtttatatagaaatgagctaaatatttgtggctgagtattttggatttagcaataattttatatatgatttgactagacttcagaacaaaaggatattcaagttcagctctaatatcttcaaggcgatgggataactcaaacaaatcttcttctttatgctcatcaaagactttaagttggatatccaggccatcattcttaatgcattttaaattctagagatatgaaatagaaattatgatgaatgattttgtttttaattatgcaaaagaataaaaaacatataaacaataaaccaaccattcaacttgatttatagcattcgaacatttaaagtgttaaataacactcgaatcttatcatctatatttcaaaaatagattttttaactcaagccttttcccacagataaattattcttcaaggtaatttatctaaatttccccctactcaagtactcttttaatttaaatattaataaggagactgcagggcacttactggcaatatctctttcaatccacaacgcataaattcatttctgatgtgaagcctgaaatccaaatcatcaggagatgtaaccagggcattgatgagctgcatacaagctacctacaagagatcaaacagtgagacagactgggtttccaacattaaagaaagagtaacaaacgtaaacttcaaggttttgttccagcattattaaatatctttcctattaaaacaatttgtaagcaaaatatttcagtcagttataaactacagaagaaataaagtttcagtggcgttttttatttctcatttatttgagggttactgaggtgaaaggaagatggaaaaatattagccgttactactgctccataaaaaaatagaaaaaaaaaaaaaaaaacacttgtaaccaaaagctaagttcttgtccaataatatcactctacacacatacaacagaaattgaacatatccaatatacctattggatagataacacttacctaaaataggataataaaatagttttccattcatcaagagagactcaaagtcccaaagacttcaaggtcaacaagggtcttaactctagttaacaaggttataaataaacactgtataattaatttctagaagttaatttatcaggcaatggttctcatactttggcaaaaattcaaaattaccctatgttttaaccagaaataaataacagagctcactaaatcctttaatatatagcttaaatgataaaaatttttaaatcacaaaattttcagctcatgtttaacacttcaactttcaacttctccacttttttcatccctggctaaaatatatctttcatcctccaaaatccataaaatggaaacaaaagacagtctttctagagaagcattctttgttgttgttgataatactatttttctaaagtctacattctatccaagtctagcaagaactactggactactgatcaatatgtttaacctcatgctgttccctaaattgtcttttctccatcccttaaggcaaggtttatatgaatttaaaatgctgttttggagtaagacaccaacagaattctcaattcctgctgtttgaaatatatagtaattgttatatttgatatctaagcattaaaatctgaccagcatgcctctactgtcgaaacttaaggttgtttaaagtgggaatgggaaatatgtcagaagagagaggaagaagagaaacatacttaaaaaaaaaaaaaaaaaaaacttaacagaatctacctttccagtacatgttcattcagctgtaaccagttcatgtcaaaaagtcaagtttaaaatgttttccttccacccccttgccagtcattacccaggacccacaaatgttttcttcagcaatgccatataatttttaaagatctcaaagagcaaataatgcttctctacattcagagaaactaaatcaaactcagtcacctggcttctagaaaaacacaaattacagataactcacagaaagtagcaaaaacaaggaacacaaaaactagcagcaaatattacctaaatggaaaatacatatatgtagacaacagtagcatgaaatttagaaataagggaaaggataatccaaattatttccgggaactattcaaaaaggtgattctccatagaagaaaaaaaataggaaattaaattgaaataatgaattcaagttaaatttataaaattgcttcccaattctaatcataatttgccattagcatggcttacaatctatttaatttaaatcatgcaaacatgtctgtgaatacacataggtatgcactaaaatgcattgtttctttatggataaataattctataatcaaggtaaagaccaaggagttccttgtaggttttatacataatgagatacatacctgcggtatcacacaatttcacaataatttagcataccagcagaagggagtgtcaatcagcatttatgccatatcaatcaacgcctagagatatcgagaaacgttaaaaaactacaaaggttaacaggacattttgcctgtccaatgaagatatatcagtaaaatgataaaaatatactatatactgtaagaaatatgtttggtaaataatgggaatatggagatgctaaatgagaactaagacagctgaataaagtactaactaaaggattaataaaatggcctgatgaagaagtgaagaaggaagatctaagccgaggaattaacatgttcaaagacatggaacctttaaattacaagcaattcaaattttatgagcggtttgtcaaggtagaaaggggagtaacgggaagaagtcaagaaatgaggttgaacaaggagacaggagagagggcatagccttgtgtgtcaagtcacaaaattcagattcaaccagaaatagtgaaaatcataaggaattttatgcaacaggggcacaataacagaggcaatagattcaagttcagaagctgttgtagaagtaaatttttgagcaaggaggaaggttcaaacatttgaaatatgaagaaaaattgatagaatgaggtagaagaaaagcatttacaagaggcctcccacttttgttatttaactagatagaaagtggtaccattagcagacatacaaaatgtaagaagagcaacaggttttagagaataggataaatcctactttcaaaattctgattgagatgtatattagaatcattcattcattaaaaaaacaattactgactacctacaacttctgtcaactggagatactcatactcaaaaaatgagaaccaaaagtgagatgttcgtcataaggaagtaatctctgtgctctagttgatgttccaaaaatgtagcatatgatctctcttaatttgcatgttacagaaatcgttatgatacattacaaaaccaacctccctctgcgctaataagggtaagaaaacaaggaacttccatcttcttgagagcatctagttaactaaaggttccatcttagggcatcagaagcagtttaccccgatattggctcacatacttcattccttcaaagcctatttattgatgcctactatataccaggcactgttcttggtgctagacatacagctgtgaaaaaagatggaaatttctttgagagaaagaggagtcaagactgactccaaggttttgggcctgagcaacttaaaggatgaaattgtaatttattgaaacagaaatgaccacgggagaaaacaggcttgggaagagagaggaaatcagttttggagatgataagttggaaatgcctattagtgatctaaatcttaaaagctgcgaaggaaattgaagatagaagactccagttcaaaataaagcaattgccatagcaataatacgtaaaaaccaagacctcagatggaatcacgacagtatagaggaaaaaggaggtgtcagaactgtttagggcattttcaaccgtaggtttcaacatggagattagagaaataagttaaagaaaaagaaaagttaaaaaccataagtgaggtagaaggaaaacaaggagattgtggtgtcctggaagtatggaaagtggtctcaacagtgagagagtgatcaactgtgtcaactggtcaaataaaacaaggactaatcaattaccactgcatttggcaaaatgaaaacactggtgacttgacaagaatagtttctacaaagggatagagttactgttccaagcagaaactacttgcctccccacagatgccatatgcagccagtaaacaaacaattgctgtaaaatattctcctctttgccctaaatgcatctttatatgttagaagtaactgctcctttatctttgtttttaaaaagtctatgtaaagacacttatctctaggtgttatggattacaaattcaattctaatggtttggaaagccaatactgtaagctcactttattactcttgtgtcaattatcaaaaagggtcttctgtgagaaaaggtattttaaacgtaacttctagctggaggggtgtgtgtccatctatgattcaggatagttgaggatttccttagggcagcagtaaactaaaagtatagtacaaggactgacatcagcaaactccagacagcctaagactggaaagcgagcggccaaaaaggtaatgacaaagagtgggacaaaagtcagcaataccataaagtaggaaggtaaagacataacaggggccaataaagtagataagctgtaaatagaaatctcaaagatattcaatatgtggggcagagcgagtcaaaggccatcttaagaacagggcaaacgatcaaaggaaaatcattagaagccgaaagaggttaacaacaagatagaggaacatgccactacatctacatcactgaatcagcaaagtggctttctgcccttgaaaataaagtgagaagttttcttcatatgtgaatatatagtacctaaatttcctttggtacataatttactgcaattactatgttcaacacaaatatgagaaaagacaaatgtgtttatttgtacaaatttattgtacatgagaaatcttgttacatgcatataaggtgcagtgatcaagtcaaggtatttagggtgtctattccccaagtacaacatatttatttggtcagatacagtcactctattctgctatcaaacattaaacttatcccttctaccatatgtttgcaccctttacacacttctcttcatccttcctcctctgcccccactcactcttcccagactgttatctttccactttctacatccatgtgatcacaatttttagctccaacatataagtgagaacatgtgatatttgtctctctgtgcttagctgatttttcttaatagcctccagttccatctatgttgctgcaaatgacaggagttcgttcctttttatggctgaatagtattccacagtgaatatgtaccacattttctttatccattcatccactgataaacacttaggtttattccatatctttgctattgtgaatagtgctgtaataaacacatgagtgccagcatccctttgaaatatttatttattttcttttgggtggatactcggtaatgagactgtttttttctaacctttggttccctgacccttttttggacaacaaacttaagcacaaaattcaaggttcactaacaggtactatccctgagccccatccacgaggaccatccagtttttccaaaggccgacagagcagaagctttcaacctgattgcgctgatgagatttagaaagttgtctaatagcaaaagtaagtagttcttagaaagtttactcttgagtcaacatgttcatcctgggtataagtagatgtttttacaattaaatcgtggctctacaatgcaacaacatatcagcttcaggagctaaatccagattgaaaacaagaaccagtaaaatacttaaataaaaattctatcagaggctgcaaaagcttattatctgggcctggaagatacagtttagactgctattcatctttcctaccccatagcagaaatcatctgtctctctttgcacaattaaatttcacatttatcaagttaaaatgagtaaatgatgcttatggagaaatattttgcctctagtgtaaatagagaaattccaaagattttaaaattttatacacatgcattgaagtaactgcatataccccacattgactcagagaaataaaatgcaggactcaagaagctataatttataccagggatactaaagaacaaacttgaattcttaaaatatttatttgaaaactcccccaagacatcattaatttcttctatgtcctcccatgcctttttctaaaactgcctttattgcaattttcgtatgaaatgttagatggctttaaattcttgagtataagcttcttaagggcagaggtgtatttcactcaactttgtagttccaatacccagcatagcccagtacctagcagtcactgaataactaagtaattgatcggttaattatgaaactttttagttaccttcaagacattaattatctttctagttgtccactgtagaataaatgaagaaatgtattatatagacttattaggtagattcagaaaactgccagtaaactctagataatgataaccattagtttatacttgggtatgctccatatgataatatgagttcacattagaatattatctgttcctttaatgtctactagcatactggcttattatttactgatccattttaatatggttgatgttttaattgattggtacttatatatcaaccctattcatgcaaacctcaataaaagtagtagtcagaagagaaaggaattaaaacaaattaacatttgcatccttccgggatagctcaacaatgatcctaaaaataagccttttactaatagtctgtattcttcatttagtccttcactaaatgtgagaaaagtttatttaaaatagaaaattaattaataattatttgatggaacagaagagacacttaaaacaaaaaatagtaaatcaagatataactgtttattataagacctttacttggtcttgggcataataaaacctgggtaaactttgaagattaaagtggtaggtggaacaaaatcaaccaaagcaaatatacttggctaaatccagaaaggcatttaacctctaatttgttttaatgtgagtattcaatggcatatttgtctgattattgcccattgacaaatttcaaaatatagtgattatccctcacttaagaaaggtttttggtactatttttgatactttaatgaaactatttatataatgataaaaagttatcctttttaatttataaaaatattgctttttctactttttcagacatggaaaaatgcaatcccatcaaactttcaaagatctatcttctaattaaacttaatgaaatccacagattgaagagtttttttttaagttaaggaaaaatttaactatctttgcagcagccataacaatgcaactctcagtctttgactgcaggaaacataaatggcctacagccccagctgctaccttctgaaagctatcacagcatttgaattgaagtcacagttccctgctcccagccaaggcttgagcacagcaagtatactaaaatagacctgttcctgggacacatgggactttggctcaaggattccccaacaggcttgtcaagctctcttagaatttcagggcagcctgagacactttcaccccatctccactccttcccactctccttcacctagagtcagatctgcattgagtttgacagttctcccagcctcccccagctcctcctccagggtctctcacaggcatttcctctagtcccttacacatcaaacctcttgcttctcatagaaccaagactaacagcctcatttcacaatgcaagtttcaacaagggttatcattttcaaattgtcagactcataagtattataactgaagcttaatcaaatttcttattttttaggtatttaacagaacacttttgctttttcttcttgttctttatatatgaccagcttctgtattttcatatgttactatgagatacgggttaagaccatgtgtatgccagacactgaaatacatttggaacacagattttctctagtaatatttccagagacaccaatagcctggattatattccttgcttttgcttccttgaaaaatatattctagggtagagaaatatctaccacaggaatcctagaaagacataccaaccatcaatcacccctgtccagtactgcatcactgttatcaccatagcttaagaagcctgaagatataagggttgcacaacaatgtgaatgtgtttaatgtcactgaactatactctcaaagatggttaaaatggtaaatttcatgttatatatatcctaccacaataggaaaaaaaaaaacctaaagcaaacaatggctatgtatttcaacagtgggtaaagaaatgacaagatctgggtcatctttactagataatcataacaagtagagatccacagaaggacaacataaacccagctattggtattatatctaaagagtatactaaaatcagatatttagaaccctgaatgaaattaagtaaaaggatttaagtatatattttaagtgagcaagctcagaactaaagatgctacagattcacatcaaaccatcaaagacaaccaaacaattttttctctctgaaacaagcttcccatcttttcctttatttgctctctgacataattatttctcctctctggactcagaaactttggaaatcatgttttccctttattcagtaactaacatagggaaaatattcttgaggtatttccaagaatcaaaattaatgagggtttcattccattcaatctacatccaagataaaaccaatgtataggaacaacattagaagaaccgggctaaaggaaaagtagccaaggtgacactaggagatttgtggtcttctgtctgttgcaagacaattctccctgggtctctcatatttcatttccacttgtattgcaagtaaagacattgatggtctttgatctagatgctcttcaaggatgtgtgtatacaaaacaatcttggaaaacagcatatctctccagagcaaagagcaggctcacttcatgtctagtataataaagataatgtcttttagagcaaagtgcaggcaagttcaaagttcctctcctacagcacatcctgccatttaccaccagaaagttctgaccatgatttgattaccattacctacactttactaagaggtcaatcagaatagatccagctcctgcatctcccatgcaaaacatcttcccttctctctggatgtcaaccccattccaactcccataactgtagctcagtcattctgtggagtgggtgaatggcactgacaaaaaggaataagttggactgactgtcttcagacagtccctccaaaaattgttagacttaattatttcctgaaccaagaactgtaaaatttatcagccacctggaagccaagttgaaagctctgccaccctgtagtcccttaactaataaagttcctatttgggtagtcccaacaactacaaacaacactttccttccaggagcaccatgtacacctttcaagactatttatcttatgtgaaagacaggcattaacttgcctctctcttcaaaaacaccatgacttgaaccctacaggtatgatcataagaaatgttcaagtgtttaaagaaatgccaccagtatgtcatgcaactcttaggcaactatggagttctctccaaatggaagctatgcttagttactctggggagcttcctggagaaaaaaactgacttactatgtgtactctgcaggcagttatccctacaatgggaagtggtaaaaaatctgtgcctgatttcagctaaagtgatcagtgacaccacatcagccctgggaggcaatcaggtcagcttcaactcactgaccaggattgttatgaagaaagaattgtcctagacttctttgctgaacaaggggaagtttgcgcaatcactaacacatcatactgtatctgaattaacacctcgggccaagtggaaagatgaatcaaaaaatttaaaaagaaagccacctggtgttctaaggtagactctgatgatttactggattatgggatttgttcagctgactagatctgggacctggaaggcaggactgaggcaaatacttcagacaggactcattctgctgcccacagtctctcctgaacttaattaagtatgctatgaaacaaactgaacagatttcatcatagcctgtatcaatcagatcaattacagtcattgctgcccataatataaaagtaatattccctatgctcaaggtttctctcctaaaacacaacccactgcaactggcagtattcacattacactatgagtgtcacaatatgggctttgggactgacacaaagctgatactcagcctactgctattgctgtgagcaataaaatcctttgtttttaacctaggagttcacgtcttttgacagcaccaatagaactatgacagactaacatgtcagtttacaagtggcagatcgtctaagaccattcatgttcctgaccctcccatcagcaacttcatgggtactggatcagggagaaaccacaggaaaaggaagttacagcattctatcactgcagacctgaggacatatacacagaagaagaaccaaatatccacccaaaatgctctaggattcccatgttttggttcccttccaaaaatatatcacaattcaatcagtcgtatgaccaacagcaagggtttcaacaaactctttgaaatctagaaaatgctcttgatactccaggaaagtatgaccctgacaagagtagacagaagacacagaaaggaaaagaaaaagaggagagaaataaaaataacagaagattaaaggacggcagaaactagagattggttaaccaatacttatcccagtccttttctactaaggaaaaactggccaacatgagggacaagcacacacatgaacaatggacactacgatggagggtttggttctcctggggcaactgtggcagaaggctgtctgtccctggtgtcacaagtgctgaccacagcagagagttgggagtggcacttccattagagcattgctgtgatacagtgcagcgtatcttctgtattacttctagctacagaccacccacatgattccctgggcctaccagaaattttgtaaggtaggtacaaaatttgtgaagtaattaattgatataggctatgatgaaatctgttcaatttgtttcatagcatatttaattttgtaataacattttctgcttaaattacccagagtgattatgttgcttgcagctgagaaaccctgtctgatgtttgaaaaaaaagtaatgtatgcttattttaagtcctagatttatatttgtactttctttcctgataatatatatgtatgtgtgtatacatatatatatagatatatctatctatctatatatagatagatagatagatatagatatatatatattttttatgagatggagtcttgctctgtcagccaggctggagtgcagtggcgcgatctcggctcactgcaagcaccgcctcctgggttcacgccattctcctgcctcagcctcccgagtagctgggactataggcacccaccaacacgcaaggcaattttttttttctttgtatttttagtagagacggggtttcaccaggttagccaggatggtctcaatctcctgaccttgtgattcgtctgtctcggcctcccaaagtgctgggattacagacgtgggccaccacgcacggcccctgataatattcttcaaggcctgagaataaagttattccaagtacaaagtttaacattttcttactatataatatcaaatgggggaagtgtgcacaattctatcataatcataaacaaattatcattattaggatcagaataacaaaaaagtaacaattctccttattctcctttaaaaaaaatactttgtcataaatatactttgcagtaaaagaataatgaagaatgtgtttattttgctatctcattttctccaatttaaaagtaaacaattggttcctattttattcaccaataaacaagttttatttttaattggcgatttgctaatgtcatctagtttagcacattttaataatgcaatttattaaaatggaataaaatgggtacaaatagttttataggaaaattgatagccagccacctcaaaatttactttatttgtggaaaattcagaaagacagagaaataggtatttttagatattactacaatttttagaaagagcataacctgcaatatgcagaaaagagtatctatgttacctttttttgtttgtttggcctaagttagcactatagaaaatggtatcttttactctgaagcctgctacctgctagctatttcacacattaggcttaaaaacaatgagaaacctttattaaggagtaaaagccttcaacaaaatatttgaatagaaaaaataagaatgtaaaacaattctttccattttctattcccaattaagagcatggaaatttaacctgaacatatcagaaaaatgagaaagaaataaatttgaatgatgctaaaataatctttcacttcttaaaaattaagctctaagaactatatcaagaaatttattttagtgtttacaggatatcaaataattaacactactactaactgtaacagaaaatataattacaactaaagcaattagtttcataaaagcaaatataatcagctacttatatattggcaaaaatttttcaaaaattgaatcatcacctactatgtcccacaaaaattaaaaattaaaaagaaactgtatcattcccgtgacttccataactacggaaggaaaacattgctctaagctctcctcctccctacctctattcactcaacactaaatatggcaaataagcagtagtttaaaaagaaatcaactccacaaatgttcacagcagcatttttcataacagccaaagagtagaaacaacctgaatgtctgtcgactgacagctgataaaatgtggtacactcatgacagacgattatgtggcgattttttaaaatgcagtactccaacatgaacgaacctctaaaatattttgctattaataagtaaaaaaagccaatcacaaagatccacataatgcatgattacatttacgtgaaatgtctggaatatgcaactctataaagacagaaagtagatcaatagttgtctcaggctagagagaatcaaagattgtggagttatagctaagggatggggactttcttttgggtggcaatgaaaatcttctaaaattgactgtggtaaagattccacaaagctgttaatatacaaaaaatattgaatcacactttttttcttttttttgagacagagagtcttgctctgttgcccaggctggagtgcagtggcatgttctcaactcactgaaagctccgcctcctgggttcacaccattctcctgcctcagcttcccgagtagctgggactacaggcacccaccaccatgcccggctaatttttttgtatttttagtagagacggggtttcaccatgttagccaggatggtctcgatctcctgacctcatgatctgcccgccttggcctcccaaagtgctaggattacaggcatgagccaccacaacctgacctgaaacgcacattttaaatgggtaaattttatgatacgttaatttagtctgactagagctgttaataaaagaaattaaacctgtatcaaaactttatataaacagaattcttaatatttatttaagtcttaatatcttctatagaatagtaacctataaaatcccaaacttttaactgatagttctctttctagatatttactgactaaatataagtttatcatgactatagaaatgttatttttccacagaagagcaccttcaataaaagcagaactacctataaaagaaattacttaatttaccccctaaattttttaaatcaacgtagtttgccttcaagttcatactcatcaatttaatttgtagttaattaaaataaaggtcagatatatttacctttatgtctaacagccaaaacaaatattccaaataaccaagaattagactgcaatagtcgaaactttccaataaatgaggagatcatgtcatttaccaggacaaaacagggctttgtctttaacaagccattatttatctcttcccttacagtttaaaacctcatgtaatgtaatactgttgtaaacaaaaggatgggaccccagttttaccaatattttcataaaacttttactctcaaataattatagattcatagatagttgcaaaaaaaaatcagataaagtaatggttcaactttcctctacaaagttttctttagggctactcttcattaatcttcagatgaataaaaagcctgggaccagatgacaaagaaacttgttcaaagcaccagatgacagcagatcaacctgacaaggaaagacataaaaaatagaaaggaaaaagaaaagcaataggaaggaaaaggagagcagggaagggggagctcagagatgaggtgggagagaagagacaagaaagcaagagaaaagaaaagaggaggagactggaaatgaggctagcagtacatgaattaaaagactctagtctctcaagcaactaaatgggcaaggtcgatgtcacagatggggaacacatcccagacctcgaagccaatgtcatctaacaagcccagaatgcatgaaaaggggctctcttacagaggttcctgcaggacccatgccatagagaccctctggtcagatcttcaatcctgcctattcgaagagaaccaaatcacaacatagggttcctcactggctattcactaacactgtcatctgaaatgtcatactaaattattagtttcacagctcctatcatattctcattttttttttttcttgagtcagagtctcgctcagtcacccaggctggagtgcagtggcacgatcttggctcactgcaaccactgtctccggggttcaagtgattctcctgttttagcctcctgagtagctgggattacaggcacctgccatcatgcccggctaatttttgtattttagtagagatggggtttcaccatgttggccaggctggtcttgaactcctgacatcaggtgatctgcctgcctcagcctcccaaagtgctaggattacaggcatgagccaccgcgcccagcctattatttttaaaataccatttgtttacttttaatttttcactttatttttttatttcagatttagcttttctattcctaatataccaagaaacaataaaatggccaagcacccagaacctttaaaaaaaaactataactttttacttttattaagtgtgaaagagatttacttcatatctattaacacattggctttgaaactttgctgcacgttaggatcacctgaggatcattttaaatttcccaatgtccaggtcacaccatgccaattaagttttagaagtacggaggtgagaatcaggtattagtattttttaagatgaccacttttgaacaattataccaataaaagcctcttttcctttttttaaaaaaagaaagagaaattaaatgaatattattcagcttgaatacttaaatgtttaagtctaaatgtgtctttttagcagtatttttggaaacatctataaccttgggtttccttattattcacgtaagctcaacttttcagttattaaaacaatgaaaagccctaatcgacctaattggcaaaacatctcaaaagttaaagtaatttaagagactaacatagaataaacagttcatagaactatgataatatctcatacagggaaatctaataattctactacacgaaaagcaacctaggaaataaccattgttgtgtgccaagatgtatctataagataaattatgacacagtacaaataggaattctatattctaaaaataatgctaggccggacgcagtggctcatgcctgtaatcccagcactttgggaggccgacgcgggtagatcacgagatcaggagatcgagaccatcctggctaacacaatgaaaccccgtctctactaaaaatacaaaaaaaaattagctgggcatggtggcaggcgcctgtagtcccagctactcgggaggctgaggcagaagaatggtgtgaacccaggaggcagagctttcagtgagctgagaacgcgccactgcactccagcctgggcgacaaagcaagactccgtctcaaataaataaataaataaataatgctataaaagaatattaaaaggcatgcagagcttcataacaatgttttcatataaaccaatcataaaaccgttaaaagtaatatatgccatttaaaaacagattttatatacacacaaaacttacttgcagttgaactgaattgtgccggaggccttccacaatacaaaaaaatctgtcaatttttttttcttcaccagctgaagttaaagcttctaaaacttcttcaaggctattggaaaatttgagtcaattaaattgcaagtagcaaacacaaatgccataatacaattgctttatcctactaaagaagtcaataccctaagcagccaatatattttagaagtagattactgagtacataccatgtatcaagcacagttctaagcatgttacattttaatcatttatccctgacaataaccctgtgaagatgtttatcaagcatttatataatgcttactacacatcaggcaccatttaagccactttacaaacatcaactcattttaaagtatataacaattgtttgaggtaggtactataattaacccgtattatagattaggagactaaggcagaaaaaggttaagcaatctgtccaaggtctcatatctgtgaaatggtggagcaagaatctgaaaccagacagtttatgtggtgggcaccatataaatgctctcaaccactgcactcttatgcctcacaagtttaagtaaatgaagctgagtgatagtcgaaaatatataatagtatggtattataaatattcaaatataaaatataataattatgcaaaaactatacttcctcttcttttaagtaatagttaacagcatccagcacactggagaagctcacagttcgtggacatgggcatgcagtcctaaatgttacttacaggatcttgatacccattctgaagtcaagaaacaaggaaaagggaaggataacagaatagggaagggaaaagaaaagcaaggaagagtccaagaggaaagaggaggaagaaaagggaaaaagaggaggttaaaagacagaattaaaaaatgatgggggaaaggggaaaggaagaaagtgggaagggaagctcagaaagtatcatatgtccacataaatttcactcttagatttgtacaccaacatttatatggccttaaatactgaagctgtatgcctggctttgcacgcttgggactgctgctgggtgtggcaacacctcttctatagataaacactgtaggcacactttgcgggcagactgccaggctgaggccgagtggtgtctttgactatccaaccatcaagccgaacctgctcaatcccaccaactccagcaggacctccacaaggctgattttcaaacgaacacaggaggctccccttacaggactctgccaacccctacatatgggggatatttctgttagttcttttgcctgtttagtttttacatttttatcttttttaaaaggcattttaaataatttttaaatgcttcctgataattagaaccctaatttttaaaaatctttatctttataattatctttaatatgtatgtaatggtatttaattatactcctaacaaatgtggttaagttctttacagctctagtgtgtgctttatgctcaaggactttgtaccctcaaccagtaaactactattacataaatcactttctaatctgccttatatatagatttccaaatcgtaatatgtttgcttttacaaggggatagagaagacctacagtttgaaataattctatgtggggaaaaaaaatcacataagaaatagaaccatttgtatattttcaaagcctccatttagaattttttttaatttagggtttcagttaaaaaaacagtttaaatatgataaggaaatcagtttttcatagaagtatgttagaccataactaataaatcaattaagagaaataattactcaaaaatttccagccaataagaaactatattagctgcttaaatatacctcaacatttatttaaattctagtaaattctagcctagagtagataatgaaacattaaatgaatcaatctgtattaaattattatataattaggggaatatgttgataacacttacatgctttcttcccctacaatgcataccgcagagagaagtttaaccacatctgtcatcatattggggtgtctgggatccacggctttggccaataaggaaaggctcctctcctcactcataattctttccaagccatactataatattttgaaaataagaggtcaaatgttagaaattagttagaaaaataataccctgaaggaaatgtagttattaaaaaaaatttataggacatttttacacttactaaagctaaaaaatatagactgtgtaacactctaaaaagttcatggctgggcacggtggttcacgcctgtaatcccagaactttgggaggcagaggcgggcagattacctgaggtcgggagtttgagaccagcctgagcaacatggagaaaccccctctctactaaaaatacaaaattagccaggcatggtggtgcatgcctgtaatctcagctactcggtaggctgaggcaggagaatcacttggacccgagaggtggacattgcagtaagccaagatcacgccattgcactccagcctgggcaacaagagcaaaactccgtctcaaaaaaaaaataaaataaaaagttcataagggtattcactttatgtcaagaaccacaaaactaaaccaaataaagataactcaaggtgatcttacaacaatacagctgacaattattaagacaggttaagtagccaaattgagaaagtgggaagcagtcagaaacatgggatttgccaacagaagcatatgaaacaaacagccagatacggaaccagacactgaggccatgaaaatctttttcctgggaaggaaggttggtaagagatatattatcataagcaaacacacagatcaacactgtccaagagaaatataatgtaaaccacatgagtaatttaaaaatttcaagcaagcaaaactattttcaataaaattaatccaatataccccaaatattaccatttcaacatataaccaatataaaacatttattgatgacatttcacttctttttcttcctaaatagttgaaatccagtgtgtattttatactgtagcacatctcaattcagactagccacacttcaaatgctcagaagccacatgtagctaccatattacaaaatacaggcctagatattagcacttagttcataaataagcaaaaactgaaggatgatttgagcagataccatgtagaaactgccacaatgggcacaggtattctaatcacaatggtatttattataaggaaaacaatgcagttgtaaactcattctataaatgagacgattgggattaggataaagtttatttactactgccaggaagtcaaatccaattagaagataagttatgttaatgatgtatctatgaaagataactgtcaaaatacagaagatgaatagaaacaataaaacagtactatttatctagcatgcatctcagaggatcctactaaagcatgagaactgactaatcagagttactaccaaacactaaaaaagggccttattcccaattacaagcctatgaactaaactcaaaatcagcactacatgtaagcattgaagttgaatctataaccagcttagacccaagtactttgattgtgataaaatcctatttataactttcctatcttgtatatggccatttatgcaaagaaaccttgtactgggctgaaatactccatttactttaaaccactatctgagaaacacaggaacaatggagaaagtatgaggaaaggccaagggcccaagaatatgaattttggagagattactctgtcttgttagtaatagggaaaagtttacaacaagacagctaaacagtcaggaaatacttacttttatgatagcctgggctattacctaactggaaaaagaatgaaaaggcaggcacaggaccagaaactacaatatgccttgctaatcattccagggaattgtcaggtttataaagtaccacttagattcaattcagaaagtcagtcaatgattaccaagtacacaagagctggctctgtcctaataaatctgggaattgagtaaagcttgcctctagcatttccccttcttttcccacctacctggttgtccttagctaacacctgcccttctagaatcagaatcctgtgactcctccagccacccaaggtgactcatgctgacttcctccaagtgatactacctgccttctctgccaaaccctctggccctaacctatcatgtatgaaaggtgaaataggagcatactctgatttcacagttttaaccatcatcctgtgaccccaaaagtccatcacaggtaacgttctctgattttggtaatgcaaaaatgtgtcacactcattttaagactggaatgaggccaattactactactcagtatctataaatacagaattgctacttgtataaattactctcaattatttaaaaaacatagcaaaacaaaacaaaaactgttgactctgtgtgagaagttgtcaacttaccagtgctcggattaaagtgcatttaatgagggctgttttaggttagagaggcatgacaaattttgaaaggtctaaggatgtatctttcctgaatgtcaaggacccactccggacaatatggtaactggcctgttctaaactgaggatcaatgccaggttcc

SEQ ID NO: 592 - DNA, 7602 bp, Homo sapiens
ccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccaggtgagaccgcgtcgggcgggcggctggaccgagggaggccaggctgggtgcaggtgggcggcgcagcgctgcggggccgggatgcggggcgggggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgaggtaagtctgtgtggggaaaaggacaatggagccgaaagccggcgtctgccgtcccgccgggcccgcgcgagatgccctcctgccccccgccctacgaggcagcttagaagtgtccttctggtgcctgcggcgctgatcgttgccgagtggaaggagtgttggagaggtagaaacagctggtcagagccgcctctgcgggaggaggcttttgaggtcgcttgttagctttcatctgagattctggctatgggagtgggcgtgcgtgtgcgcaccgtggccccaggcgaggtttcgtcttttcccaatttgtaccaccacccattaagcgacttcaaggatccatcaaaaatgattggttcctaagcgaacagttttattttttgtattttaagattccattagttgtgtaatggtaggggcctggagcccaaaaccttggcgttactaggacagggcatgacccagctgacttggagtaaattttctgcctttaactacatttagattggaaattagggtaaaatgtttttgttgcaatctagtttcgagcatgtggtcctgtgattctgggtttgttttataacttatggactgagtaaaattacccagtttactgagagaattgagaactctgtgcaatggttgatctaatagaagcattttatttaaagcttccacccatccagttgctaatttatgttatttctcttttaaattatgtagattttgttgttgttgttgttgcagaaatggctccgtaaaatgattagttttgtgcgtgtgtgtgtgcgaacagttacacagttaagttcgttttcctgatagttttcttttgtctttagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggtaggtgaaaattatgacttggaatagacaaagactctcccctcttcaaactataatataatggtccttatagtgagtgctatgaaaaccaaattttagatttttccagttacataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcacacctgtaatcccagcactttgggaggccaaggcgagcagatcacttgaggtcagagtttgagattagcctggccagcaatggtgaaaccccttctctactaaaaatacaaaaattagctgggcggcggggtttgtgcctgtagtctcagctacctgggaggctgaggcaggagaattgctcaaacccgggaggcggaggttacagtgagccaagattgtgccactggactccagcctgggtgatagagtgagacttgtctcaaaaaaaaaaaaagaaaagaaaagaaaaaagtatgtatagagtggggtgcagaagaatgaactctctaacttgtcacttgtcttttcttcttttataaaacaagaatgattctatttatactgaatcatcatgatggttattaatttaccttatggttcctcaagcaaattcagaaaaatcacattatataatttttttaaggggcactgctatctttccccagaaaaagaacaaaactgggtagtatttttttcatatttcattaaaatcaggaatggttttgacggtttgtaaagtaggtagtgaaaaagatatgaattaaattccattttgtttggtgtttagtcaagtaggaacttttcattcatgtgtttcataacattatttagagtataactgagaattgtatgttgggagatttattttgaaatatgtacttcttttccccttttcaatccttgaaaggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggtattcttttgactctttttttacttattctttctttctcttatttaataatcttttctttcctttgtaatttattttgtgaaatttccagaaagactttggttctgtctgcatcacattataaaacataataaagcatttctatttacaagcaagtttcaggataaagtagtcttattttcagattttttttttttttttgagacggagtctcgctctgttgcccaggctggagtgcagtggtgcgatcttggctcactgcaacctccacctccccggttcaagtgattctcatgcctcagcctcccaagtagctgggattacaggtggccgccaccacacctggctaattttttttaaggggcactgctatctttcctcagaaaaagaacaaaactgtttgggtagtattttttttcatgtttcattaaaatcaggaatggtttgacggtttgtaaagtaggtagtgaaaaagatatgaattagattccattttgtttggtgtttagccaagtaggaactgttcattcatgtgtttcataacattatttagaatataactcagaattgtatgttgggagatttattttgaaatatgtacttcttttccccttttcaatccttgaaaggaaaatattgtaatgggagagttgttcctactgatttttattagagatggggtttcaccatgttggctaggcttgtctcgaactcctgacctcaaatgatctgctggcctcggcctcccaaagtgctgggattacaggtgtgagctactgtgcttggcctttttcagattttaaaatacgatggaaatggttgtggtgttttaaggtgtaaaaaaagaaaaaaatactccgggcctggtggctcacgcctgtaatcccagcagtttggggggctgaggtgggcggatcacctgaggttgggagtttgagaccagcctgaccaacatggagaaacctcgtctctactaaaaatacaaaattagctgggcacggtggtgcacgcctgtaatcccagctacttgggaggctgaggcaagagaattgcttgaacccgggaggtggaggttgtggtgagtggagatcgcaccattgaactacagcctgggcaacgagcaaaactccatctcaaaaaaaaaaaaaaaaactggtgggcacagtggctctcacctgtaatcccagcacattgtgaggccaaggcaggaggatgacttgagcccaggaatttgagaacagcctgggcaacaaagcaagaccccaccactacaaaaaaaagtacacgcgcacacacacacacacacacacacacacaaatacaaatgcaaactgtattatgctatggtcacaggattgatcttttttagcttttatttttcttgctctgaaaactgaaatttttctttaaattggagtagagcgttagtattttttgttgttgttgaaacaagagtgtcgttctgtttcccaggctggagtgcagtggcacgatcttggctcattgcaagctctgcctcctgggttcttgccattctcctgtctcagcctcccaagtagctgggactacaggcgcccgccaccacgcccagctaattttttgtatttttagtagagacggggtttcaccgtgttagccaggatggtctcaagctcctgacctcgtgatccgcccgcctcggcctcccaaagtgctgggattacaggcgtgagccaccacgcccagcctttttcttgtttttggttttttttttttgctttttttgtttttgtttttgtttttgtttttgagacagagtctcactctgttgcccaggctggagtccagtggtgcgatctcggctcactgcaacctctgcatcctgggttcaagcacttttcctgcctcaccctcctaagtagctgggattacaagcgtgcctcaccacactggctaattttttttttttgagacggagttccactcttgtttcccaggctgtagtgtagtggcgcgatctcagctcaccgcaacctctgcctcctgggttcaagcgattctcctgcctcagcctcccgagtagctgggattacaggcatgtgccacaatgcctggctaattttgtatttgtagtagagatgggatgggatttcttcatgttggtcaggctggtctcgaactcccaacctcaggtgatccacccgccttggccttccaaagtgctgggattataggcgtgagccaccgcgcccggctcacactggctaatttttgtatttttagtaaaaatggggttttgccgtgttggccaggctggtctcgaatgccagacctcaggtgatcttcctgccttggcctcccaaagtattgtgattacaggcatgagccaccacgcctggtctagaacattaatattaatatattaaaatgtgaacactaattatctagcgtagatgatggaattaggagtatttttccccctttgtcctggtgctactatcagttgtaatttcaaaataatttaaaaataggctgggtgctgtggctcatgcttgtaatcccagcactttgggaggccgaggcaggcagatcacctgaggtcaggagtttgagaccagcctagccattatggccaaaccccgtatctactaaaactacaaaagttagccgaatgtggtggcgggtgcctgtaatcccagctacttgggagactgaggcaagagaactgcttgaacctggggggcggaggttgcagtgagccgagattgtgccactgcaacccagcctgggcgacagagtaagacaaacaaaacaaaacaaacaacaacaacaacaaaaagatttaaaaataaatttgataaattggagtaggatattcttattgaaactcattaatacatagtattcttgttaataggttcagtttaataggaaagctactagagaactctaatgaaatgtgttttcttttaaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttcttgtctcttggacaaaatcctagctttactgtaatttaaaaagatgagtttaaaatttcaggctttaaaaacataccaaacattgataaaaatgaaatactagataaaagtattttatcaatgttcagttgcctggattcaataactgtattatggttatgtaagataatatacttaggaaatacacattatggtattaaagggttaaagaggtatggtgcatgcaacctgatgatgtatgtagtctgctttctaatgattcagaaaaataaatgtgtgtgtgtgtgtgtgtacacacacagagaatcataaagcaaatgtaattgttaaaaagttgaatctctgtaaaaagtatgtgggagtgtctgtactatgctttctagttttctgtacatttctagttatttagaaataaaaagttttaaaaacctg

SEQ ID NO: 593 - DNA, 31279 bp, Homo sapiens
ccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccaggtgagaccgcgtcgggcgggcggctggaccgagggaggccaggctgggtgcaggtgggcggcgcagcgctgcggggccgggatgcggggcgggggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgaggtaagtctgtgtggggaaaaggacaatggagccgaaagccggcgtctgccgtcccgccgggcccgcgcgagatgccctcctgccccccgccctacgaggcagcttagaagtgtccttctggtgcctgcggcgctgatcgttgccgagtggaaggagtgttggagaggtagaaacagctggtcagagccgcctctgcgggaggaggcttttgaggtcgcttgttagctttcatctgagattctggctatgggagtgggcgtgcgtgtgcgcaccgtggccccaggcgaggtttcgtcttttcccaatttgtaccaccacccattaagcgacttcaaggatccatcaaaaatgattggttcctaagcgaacagttttattttttgtattttaagattccattagttgtgtaatggtaggggcctggagcccaaaaccttggcgttactaggacagggcatgacccagctgacttggagtaaattttctgcctttaactacatttagattggaaattagggtaaaatgtttttgttgcaatctagtttcgagcatgtggtcctgtgattctgggtttgttttataacttatggactgagtaaaattacccagtttactgagagaattgagaactctgtgcaatggttgatctaatagaagcattttatttaaagcttccacccatccagttgctaatttatgttatttctcttttaaattatgtagattttgttgttgttgttgttgcagaaatggctccgtaaaatgattagttttgtgcgtgtgtgtgtgcgaacagttacacagttaagttcgttttcctgatagttttcttttgtctttagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggtaggtgaaaattatgacttggaatagacaaagactctcccctcttcaaactataatataatggtccttatagtgagtgctatgaaaaccaaattttagatttttccagttacataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcacacctgtaatcccagcactttgggaggccaaggcgagcagatcacttgaggtcagagtttgagattagcctggccagcaatggtgaaaccccttctctactaaaaatacaaaaattagctgggcggcggggtttgtgcctgtagtctcagctacctgggaggctgaggcaggagaattgctcaaacccgggaggcggaggttacagtgagccaagattgtgccactggactccagcctgggtgatagagtgagacttgtctcaaaaaaaaaaaaagaaaagaaaagaaaaaagtatgtatagagtggggtgcagaagaatgaactctctaacttgtcacttgtcttttcttcttttataaaacaagaatgattctatttatactgaatcatcatgatggttattaatttaccttatggttcctcaagcaaattcagaaaaatcacattatataatttttttaaggggcactgctatctttccccagaaaaagaacaaaactgggtagtatttttttcatatttcattaaaatcaggaatggttttgacggtttgtaaagtaggtagtgaaaaagatatgaattaaattccattttgtttggtgtttagtcaagtaggaacttttcattcatgtgtttcataacattatttagagtataactgagaattgtatgttgggagatttattttgaaatatgtacttcttttccccttttcaatccttgaaaggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggtattcttttgactctttttttacttattctttctttctcttatttaataatcttttctttcctttgtaatttattttgtgaaatttccagaaagactttggttctgtctgcatcacattataaaacataataaagcatttctatttacaagcaagtttcaggataaagtagtcttattttcagattttttttttttttttgagacggagtctcgctctgttgcccaggctggagtgcagtggtgcgatcttggctcactgcaacctccacctccccggttcaagtgattctcatgcctcagcctcccaagtagctgggattacaggtggccgccaccacacctggctaattttttttaaggggcactgctatctttcctcagaaaaagaacaaaactgtttgggtagtattttttttcatgtttcattaaaatcaggaatggtttgacggtttgtaaagtaggtagtgaaaaagatatgaattagattccattttgtttggtgtttagccaagtaggaactgttcattcatgtgtttcataacattatttagaatataactcagaattgtatgttgggagatttattttgaaatatgtacttcttttccccttttcaatccttgaaaggaaaatattgtaatgggagagttgttcctactgatttttattagagatggggtttcaccatgttggctaggcttgtctcgaactcctgacctcaaatgatctgctggcctcggcctcccaaagtgctgggattacaggtgtgagctactgtgcttggcctttttcagattttaaaatacgatggaaatggttgtggtgttttaaggtgtaaaaaaagaaaaaaatactccgggcctggtggctcacgcctgtaatcccagcagtttggggggctgaggtgggcggatcacctgaggttgggagtttgagaccagcctgaccaacatggagaaacctcgtctctactaaaaatacaaaattagctgggcacggtggtgcacgcctgtaatcccagctacttgggaggctgaggcaagagaattgcttgaacccgggaggtggaggttgtggtgagtggagatcgcaccattgaactacagcctgggcaacgagcaaaactccatctcaaaaaaaaaaaaaaaaactggtgggcacagtggctctcacctgtaatcccagcacattgtgaggccaaggcaggaggatgacttgagcccaggaatttgagaacagcctgggcaacaaagcaagaccccaccactacaaaaaaaagtacacgcgcacacacacacacacacacacacacacaaatacaaatgcaaactgtattatgctatggtcacaggattgatcttttttagcttttatttttcttgctctgaaaactgaaatttttctttaaattggagtagagcgttagtattttttgttgttgttgaaacaagagtgtcgttctgtttcccaggctggagtgcagtggcacgatcttggctcattgcaagctctgcctcctgggttcttgccattctcctgtctcagcctcccaagtagctgggactacaggcgcccgccaccacgcccagctaattttttgtatttttagtagagacggggtttcaccgtgttagccaggatggtctcaagctcctgacctcgtgatccgcccgcctcggcctcccaaagtgctgggattacaggcgtgagccaccacgcccagcctttttcttgtttttggttttttttttttgctttttttgtttttgtttttgtttttgtttttgagacagagtctcactctgttgcccaggctggagtccagtggtgcgatctcggctcactgcaacctctgcatcctgggttcaagcacttttcctgcctcaccctcctaagtagctgggattacaagcgtgcctcaccacactggctaattttttttttttgagacggagttccactcttgtttcccaggctgtagtgtagtggcgcgatctcagctcaccgcaacctctgcctcctgggttcaagcgattctcctgcctcagcctcccgagtagctgggattacaggcatgtgccacaatgcctggctaattttgtatttgtagtagagatgggatgggatttcttcatgttggtcaggctggtctcgaactcccaacctcaggtgatccacccgccttggccttccaaagtgctgggattataggcgtgagccaccgcgcccggctcacactggctaatttttgtatttttagtaaaaatggggttttgccgtgttggccaggctggtctcgaatgccagacctcaggtgatcttcctgccttggcctcccaaagtattgtgattacaggcatgagccaccacgcctggtctagaacattaatattaatatattaaaatgtgaacactaattatctagcgtagatgatggaattaggagtatttttccccctttgtcctggtgctactatcagttgtaatttcaaaataatttaaaaataggctgggtgctgtggctcatgcttgtaatcccagcactttgggaggccgaggcaggcagatcacctgaggtcaggagtttgagaccagcctagccattatggccaaaccccgtatctactaaaactacaaaagttagccgaatgtggtggcgggtgcctgtaatcccagctacttgggagactgaggcaagagaactgcttgaacctggggggcggaggttgcagtgagccgagattgtgccactgcaacccagcctgggcgacagagtaagacaaacaaaacaaaacaaacaacaacaacaacaaaaagatttaaaaataaatttgataaattggagtaggatattcttattgaaactcattaatacatagtattcttgttaataggttcagtttaataggaaagctactagagaactctaatgaaatgtgttttcttttaaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttcttgtctcttggacaaaatcctagctttactgtaatttaaaaagatgagtttaaaatttcaggctttaaaaacataccaaacattgataaaaatgaaatactagataaaagtattttatcaatgttcagttgcctggattcaataactgtattatggttatgtaagataatatacttaggaaatacacattatggtattaaagggttaaagaggtatggtgcatgcaacctgatgatgtatgtagtctgctttctaatgattcagaaaaataaatgtgtgtgtgtgtgtgtgtacacacacagagaatcataaagcaaatgtaattgttaaaaagttgaatctctgtaaaaagtatgtgggagtgtctgtactatgctttctagttttctgtacatttctagttatttagaaataaaaagttttaaaaacctggctgcacgtggtagctcatgcctgtaatcccagcacttggggaggccaaggtggaaggatcacttgagcccaggagttcgagaccagcctgggcaatatggcgaaaccctgtctgtacaaaaaatacaaaaattaactgggcatggtagcacacatctgtagtctcagctattttggaggctgaggcaggaggatcactcgagcccagaaggttgaggctggaatgagtgtttatcatgccactgcactccagcctaggcgacagagtgagactctgtctcaaaaaaaaaaaaaaaaaagtttttaaaacctgaaaaaaggccaagtgtgttggctcacggctgtaatcccagcactttgggaggctgaggcgggcgggtcaggaggtcgagaccattctggctaacacggtgaaacaccctgtctctactaaaactacaaaaaattagccaggtgtggtggcgtgtgcgtgtagtcccaactactcgggaggctgaggcaggagaatcgcttaaacccgggaggcagaggttgcagtgagccaagatcgtgccactgcactccagcctgggtgacagagcaagactctgtcacaaacaaaaaaaaaaccataatttaaaaaaaaaaaaaaaagagtttttttttttggagacagagtcttgctctgtcacccaggctggagtgcagtggtgtgatctcggctcactgcaacctctgccacctccagggttcaagtgattcttctgcctcagcctcgcgagtagctgggattacaggcatgtgccaccacacccggctaattttgtatttttagtagagatgaagtttcaccgtgttggtcaggctggtctcgaactcctgacctcatgatctacctgccttggcctcccaaagtgctgggattacagccgtgagccaccgcgcccagccgagttttctttttcagagatcagaaaaaaaagaaaaaagtcctgaaaaaaattttacagacttatttcaagataaattagaaaccaagtaaaatcagtgtatttttgctaggtacttaaaggactattttgtatcttttaaattatctgttcatcttttaacttgctcatatttataaccttttcatgatgaatgatattagaatacatgactaattatacagaataattttctttttaatttcatttataggagaacctttacaaatagatcacttggtttttgtagtccatgggattggaccagcttgtgatctccgctttcgaagcattgtacagtgtggtaggtttgcaaagcatgtgagagaatattaatcagtgctcttgtgagctgagataaagccttgtctttggtctattgtcttagctgcataagaagatttggagagttaaagacaggtggcaaggtagtaaagcttctcagcttagacctgaagtgctaggaaattcctgagtctaatagtttatactcttaactattgtaatagtctcaaatgaacaagcagttaatccctataaaattgtgttttatgatgtggtggtcctatttctaactatttcaaatttacagggaaccataaagatgatagagtttaatgaataacagaagcatcaatcatttttgtaattcatactgtgataaacctttgatattgtaattggaggatttaagtcattagtataactagattttgaaaggtgtcctctaggctgggtgcggtggctcacgcctgtaatcccagcactttgggaggccaaggcaggtggatcatgaggtcacgagttcaagaccagcctggccaagattgtgaaacgctgtctctactaaaaatacaaaaattagccgggcgcagtggcaggcgcctgtaatcccagctactcgggaggctgaggcaagagaatcacttaaactcggagggcagaggttgcagtgagccgagatcgggccactgcactccagcctaggcaacagagtgagacctcaaaaaaaaaaaaaaaaaaaggtgtcctctaaaacctgatagtattcaaagtttaattgttccaattagggtgtcttattctaactggctaatggttctaaacataaactagaattgtattgtggaaggttgagactgatgtgatatgaatttcaaacaacagtgtatttttttttctttaaagtattgggtggtgcttgtttataagaaccagaaagttagggtaggaattcaactgcaagactgttgttatattgtcatgtgattaaaaaaaaaatgaaacagttctcatgatgccgacgttttgaagtttagctttctttttttttccttttcctttttttttgtttttaaatatattattttctttcctgagacaagagctttgctctgttgcccaggctggagtgtagtggtgtaaactcagctcactgcaacttctgcctcccgggttcaagtgattatcctgcctcagcctcctgagtagctgggattacaggcgcacaccaccatgcctggctaatttttgtatttttagtagatggggtttcgccatgttggccaggctggtcttgaactcctggcctcataaaatccacctgccttggccccccaaagtgctgggattacaggcatgagccactgctcctggcctgaagttagccttcttttgatgaaatattttgtatggtaaaagcaagttgttaggccaggcacggtggctcacacctgtaatcccagcactttggggggccaaggcaggcagatcacctaaagtcaggagttcaggaccagcctggccaacaggacaaaaccccatctgtactaaaaatacaaaaattagctgggcatggtggtatgtgcctgtaatcccagatcctcaagaggctgaggcaggagaattgcttaaaccagtgaggtggaggctgcagtgaggtgagatctcgccactgcaccccagcttgggttacagagcagtactccatctcaaaaaaaaaaagttattaaagaaacatcttttcctatatgcattcataatttttcctgaataccactttatttttgacggaagtcagtatgtgttctgtgcaaatgtagttagagtataattacatgatttgttgcatccagattctacagatttgttacttcattgttgatgcataagttaattttcttttccagttaatgattttcgcagtgtttccttgaacttgctacagacacattttaagaaagcccaagaaaatcagcagattgggagggtagaatttcttccagtcaactggcacagtcctttgcattctactggtgtggatgtgtgagtaatacttaataccttcgagttgttagctgtgattatattttctgatcattgctatgcttggggacgtttttatgctatagctgactgaatatttaaaatttcttagagatatgctattaaatgctgatcagtcccttggtttaattagccctggttaggagtggagagctgtgtgtatcttcagtatgttttactggctcactagtatttactgttacagcttcattgtatctttagcattaaagccaaatattgctatcttcccatagtgtataaccatttccatcttcagatgtcaaaagctagccataccccaagatgtacaaagtattttgttgttccttttgttattatatttaaataatatttgtccaaatttagaaaaaaggggggatttctcaaacattaaactactagcatttaaaacttgaggtataattggtacagtgacttttaagtgatggctttcttaaggtacaagaccattagttttgtttgtaaattttatggtaatgacagagaatgttgcttaaattgaggatatctagctatggggctctccagcaagtagtgtgtttctaatgtagttctagaatagaaccaggagatgcaggaagtagtcagcattgtttccatgctggtctcagaaatggcttttctgattctgtgtctcagttctcagtaccctgtgatttgggtatattctgtttgccaaacactgtggtggggtccggattcttcaatatttgagcagatgctaagaggttactaagggcacgtagcccttataaattgcagaagtggttgaatatttgaggaatctttctgggaattttaagaaacctttaactggatgttagattttgtcagcgtggtcttcctctcccagatatgaattctgtttgcttttggcacctggcactcacacctttttctgcttttagaaattgtgcattgagagagggagctgatctctttatcgtttgacctgtaattaaaaaaccttactgctgagaattccaggaaaagccttttacattttttgttttgtctttttagaaaacttttttttattagagataattttgttcacagaagtagtatatatgatgaatccttgtatactgattacccagccctaacaagcctcaacacatggctggttctgcctcaaccgtatcttcataccttatctaatgccccttcatcaccatatgatttttatcttagacatcctgtaatttcatctgtaaatgtttcagtttgtatcttttttttttggttggagtgcagtggtgtgatcacagctcactgcagcctggacctccctgggctcagatgatcctcctgccccagcctcccaagtactgctgggactacaggcatgtggcaccacttgcagctgattttttttatcttttttttttttttttgagatggagttttgctcttgtccaggctggagtgcagtggcgtgatctcagctcaccgcaacctccgactcccgggttcaagcagttcccagtcttggcctcccgagtagctgggattacaggcatgcgccaccatgcctggctaattttgtatttttggtagagacagggtttctccacgttggtcaggctggtctcgaactcttgacctcaggtgatccgcccgtcttggcctccccaagtgctgggattacaggcgtgagccaccatgcctggcccaatccagctgatttttctattttttgtagagatgggcttttaccatgttggccaagctggttttgaactcctgggctcaagcaatctgtctgctttggcctcttaaagtgctgggattacaggtgtgagccacagtgcctggcctgaacagtatattttattttttattttatttttgagatggagtgtcgctctgtcacccaggctggagtgcagtggcacggtctcggctcactgcaacctctgcctcctgggttccagcaattctcctgcctcagcctcccaggtggctgggactacagtcatgcgccacaatgcccagctaattttcgtatttcttagtagagacagggtttcaccatattggccaggctggactcctgacctcatgatctgcccgcctcagcctcccaaagtgctgggattacaggtgtgagccactgcgccggcctgaacagtattttttttgttgttttttttgagacagagtcttgcactgttgcctgggctggagtgcaatggcacaatttcggctcactgcaacttccgcctcctgggttcatgtgattctcctgcctcagcctcccaagtagctggggtaaaggtgcacatcaccacacccggctaattttttgtatttttagtagagacggggtttcactctgttggacagactggtctcgaactttggacctcgtgatctgcccgcctcagcctcccaaagtgctggcattacaggcgtgagccaccgctcctggccctgaacagtatattttaaaggacttaaaaaatgtataaccataacactattatcacacttaaaaatttcttaatatcatcaaatacctagtctgttcaaatttccagttgtctattatatttttatacatattttatacatatttttatatacattaattatataattatatacattaatttttgtatacatatttatataattacaaacatgttttaaactgggatccaaataaagcccataccttgcaattagttgatatgtcttttattataagtctctcttgggctgggcatggtggctcatgcttgtaatcccagcactttgggaggccgaggcaggtagatcatctgaggtcaggagtttgagaccagcctggctaacatgacaaaaccctgtcactactaaaaatacaaaaattagctgggcatggtggcacatgcctgcaattccagctatttgggaggctggggcaggagaatcgcttgaacctgggaggcagaggttacagtgagctgagatcgtgccactgccctccagcctgggcaatagagcgagagtctgtctcaaaaaaaaaaaaaaagaaaagtctctttaatttattttcttgattaccacttacctctctgtctacatctgttgttttcttgcagtttatttatggaagaaatgggtttgacttgagggttttttatactctgaattttgcttatcacattcctctggcttcattacacatgttcctttgtcctctttttgttttttcctataaatcgacaattgtttgttataaaatgtttaagcttgaaggcttaaaattggaagcagctattaagtgtatttaggtttcctgcttatattatttttccttttttcagagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggtaacaaaatgagttctgtgtgaccagagaagactatcacattttaaagacacctgtttttgaagcacaatgtcttttatcagtatgaaattcagaggtctagaagtggtctgtggtcaggaaatttggaaggggttggaagggtggcggtaaattggaaagaaagactccttgctgtatagatttgcttacatatgtaattggcttatgccttttttgtataacagagagccatttagtgctaatgcttagaaattgtcccttcttctattttacttataggttcgcttatattgtttgatatcctaacaaatcagaaagattctttgggggatattgacagtgaaaaggtaatttagatgttcagctaggttttcttgtagttttccttagtaaggatttatagattttagacttattttttgtttttagctgagtttagtttcatgtcatgacattacatttacacttattttcattttaacagacttttaattatctctgtcattcttggatgatagaaggaagatagtaacatgcttctacaaataataattgttatattctaaaccatagttatcttattttcttttgtgaatatgcaccactggctgggcgcggtggctcatgcctgtaatctcagcactttgagaggctgagactggtggatcaccttaggtcaggagttcaagaccagcttggccaacatggtgaaaccccatctgtactaaaaatacaaaaattagctgggcatggtggtgtgtgcctgtaatcccagctacttgggaggctgaggcaagagaatcgcttgaacctgggaggtggaggttcagtgagctgagatcgtgccactgcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcactgttttcctaatttcttaagcactgagctcccttaaaattcagcaaatgtttgttaatgatgatgaatattttactaatttctttaaaaacatattttcaattgaagttgcaaaaccttggaacctcttaatttatatcttgcataaatgacaatttgttaaagttaagatacattgctgtggaaatctatgtatttctttactgcaaaatagtattaaaggaaactaaatgaatttcaagaatatgagctttataatttaatttttaggattcgctaaatattgtaatggatcaaggagatacacctacactagaggaagatttgaagaaacttcagctctctgaattctttgatatctttgagaaggagaaagtagataaggaagctctggtaaaaataatcttttaaaactttatgccaagccattttcagtatttttgtttatcgtgtttactaagagcctaccctttagacactttttagtcataaatactttatgattaatgttccttagcattatttatttgctttttatcatatcaagtgacctttgctttgtggaagttcaaaggtcagatggccatattgatattcatagagcaatggagcagactaaccagtacggctcatagaaaacatgagtgcaagaacaaacaaataaataaccattagctattccaactctaattttctgttgtactttcaagagctctactgttatttgcgagtagctgggattacaggtgcccgccaccacgcctggctaattttgatatttttagtagagatggggtttcactgtattggccaagctggtctcttggccaggctggtctggaattcctgaccccgtgatccacccaccttggcctcccaaagtgctgggattacatgtgtgagccaccgtgcccagccagctgatttgtttttttttttttttttccatttttgtcgtgcctttttctggtttgtgatacattcactcatttaacagatatttagaaaatgcttactataccaagtactggatagactggtgaataagacatatgatccctgacctcatagtgtttatagtttactggggaagacacatgttaaataatcacacacatcatggcaattacaataagtaagtaggaaaagtacaccgtgttgtaagaattaacctggtctcataaggtgcaggaaggcttccctaatcaaatgagtgatagctggctgggtgtggtggctcatgcctgtaatcccagcactttgggaggccgaggtgggcagatcacgaggtcaggagttcgagaccaatctagtcaacatggtgaaaccctgtctgtactaaaaatacaaaaattagctgggtgtggtggcacacacatgtagtcccagctacttgggaggctgaggcaggagaatcgcttgaacccaggaggtggaggttgcagtgagctgagatcacaccactgcactccagcctgggcgacagagcaagactccatctcaaaaaaaaaaaaaaaaaacgatgagtgacacttgagatcttgattgttagtctgttccatacttgtgtgtttgctgtatgttctcagtgcttgcgttcatcagcaggagtataatccttctcaggcatgtgacatctaagtcagtatagaaatcaaggaagtttttttgttttgttttgtttttttgagacggagtcttgctctgttgcccaggctggagtgcagtggcgcgatctcggctcactgcaagctctgccttccgggttcacgccattctcctgcctcagcctcctgtgtagctgggaatacaggtgactgccactgcgcctggctaattttttttgtatttttagtagagacggggtttcaccatggtctccatctcctgacctcatgatccacccgcctcggcctcccaaagtgctgggattacaggcgtgagccaccgcgcctggccagaaatcaaggaagatttttatgtcctgaagtccttagatacccaacttctctgttttttttttttttttttaacaataacaatgtctatattattgtaacattgatattataagtattgatattttctattcttttttaggctgtttcatgaataaaacaggtccttttttctggaagttattctatgatgttttactactagagagacaggcagcaacagagtgcctaggccttgttcctcttaggggacaggattgattttattttgtctagaaataagaaagacttgattttctatgcctaggctttatgtacagaccgagatcttcaggaaataggaattcctttaggaccaagaaagaagatattaaactatttcagcaccagaaaaaactcaatggtatgtgcctaatacagcttgttggactaaacaattctttgatgtccatagtgtgtccttgtgctttgtgggatgtttactctggggagccaagcagttttttggtaattgatctttggctctttttttttgagacagggtctcgctctgtcactcaggctggagtgcagtggtgtgatcccagctcattgcaacctctgcctcccgggttcaagcgattctcctgcctcagcctctcgagtagctgggactacaggcgcccaccaccatgcctggctaatttttgtatttttaatagagacggtgtttcaccatattggccaggctggtctcaaactcctgaccttgtgatctgcccgccttggcctcccaaagtgctgggattacaggtgtgagccacccgcctggccgatctttggctctctttctagaaattaaacacattttcttttttacattcttttttttttcttttcctggaaatgaaatctcgctgtgttgcccggggtggagtatagtgggtggtctcggctcactgcaacctccaccttccaggttcaagcaattctcctgcttcatcctcttgagtagctgggattccaggtgtgcaccaccatgcccagctaactttttgtatttttagtagagacggggtttcactatgttggccaggctggtcttgaactcctgacctcagatgacccatgtgcctcagcctcccaaagtgctgcaccgctcctggcccttctttttttacatccttaaaagtattattagcttcagaagtcttctctcctctggaattctcctaccatttatttatttatttattttttgcttttttcttttcatgagagttttaccaatatctacttcacatcacataccataaaattcacccttttaaagtttacaatttaatggtttttagtatattcatagagttatgtaaccattaccactatccaatttcagcacatttccattgtcccttagggaaaccccatacccatttgctgtcactccccattgctccctgcccccagcctctgtcaaccactaatctactttctgtttctacagatttgcttattttggacattccatataaatggaatgtccttttgagccatgtgtctgacttctttcacttagcataatattctgaaggtttacctgtgttaacagtacttccacattcagtttttctggtcactgaatttctaactccatatcttattagttagtttttttctttttgagtcggagtgttgctctgtcgcccaggatggagtgcagttgcacgatcttggctcaattgcaacctccgcctcctggattcaagtgattctcctgcttcagcttcctgagtagctgggattacagacacgcgacaccacacccagctaatttttgtatttttagtatggggtttcaccatgttggccaggctggtcttgagctcctgacctcaagtgatccgcccacctcagcctcccaaagtgctgggattacaggcgtgagccaccatgcctggccagtagttagttcttttccaactttttagcaggtggctcatttctttttaaagactcagttcttggcccagcccatcgacatcctacttcccttgattacagaggcacagcacttcatagaactctagcaatcctcagcattatcttcccacagtgccctgctattgttttctcttatgattgttgcctaaagtttcaacgctactgaaatggctatgtacaactttcatcattttagagcatctaagaatgtcaattaacaatttaaggcaataatttaatcttgttttctgaggaaatcttcctagaatttttggctgccatttcagaactttcccaagggtcctttcaaaccagtagaaaactatataatcctttggctatacttttactatatagtagctccccatactttttttttaaatagagactatgttgcccacgttggacttgaactcttgggcttaaacaatcctacctacctacctacctcagggtcctgagtagctgggactacaggtgcatgccgtcatgcccagcttctccacataactattttttattctttagggtattaagagaccagccccgcagcctgcttcaggggcaaacatccccaaagaatctgagttctgcagtagcagtaatactagaaatggtgactatctggatgttggcattgggcaggtaactaattctctttgatcattttacagcctgctatttgtatggtagaaacagatgtaacttttgttattaatgagagatgcttttattttcctcctttgaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcaccctgtaagcattgtacagctattgtggttttacctaaatatcagggcttattgttaaagaacataggattttctgttgtgttgatttttttttcctattccattgtctagcaatgagacaacttataatagtattgatttggaagtgatggagcagaactgtacatttttttaaatgaacttatgattattgtttaagatacatagttctggttgtacatggtgactaatgcctgtcatcccagcactttgggaggtcaaggcaggaggattgcttgagcctaggagttgaaggctacagtgagccatgattgcaccactgcactccagcctgggtgacagagcgagacctcatctcaaaaaaaaaaaaaaaaaagttatatagtttccagactgtgcttagcagaggtaaatgtagctcttgtttttcctatgtagtttgatcctgtggcctataggattgaaccaatggtggtcccaggagtggaatttgagccaatgctgatcccacatcataaaggcaggaagcggatgcacttaggtaagtccgagcatagaacttgataattctagaccttttggccagtgcaaagggcatcattcactctgttcagctatgttggaccctaagctctttgtaaatcatttaatgttctttatttatatgtttcagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtggtcagtgacactgtacacattgaccagctgccagataagagggatgccatggtgtggcgtttttcatagttaatttaatttaatttcacatttaatttcatagttaatattgcattcttttgctttagttttcaacttctaaagagctctattcctgcttgcatttagtataaacccaaggcaaatgacctagctatcaatggtataggtaatgagatgtgttgcgcaaaagcaaaaaaggggattggacaaaattactgtgacctgagaaggagcttgaaggagattgagaggaggaagatgggagagagctctctgaacagagagtagctcattctctggtaaacttggagtgtgaggagaagttaacaggataaccctgaaggccaaaaggttttagattcttattatggttcttccatatccagatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactggtaaatgttgtttatttttgtctgttttgtttgtttacctgtttcatagatatttgatagatgtagaaaaaggaggataggccaggtgcattggctcaggcttataatctcagcactttgggaggccaaggtgggaggattgcttgagttcaggagtttgagaccggcctgggaaacatagcaagacctcatctctacaaaaactaaattagctgggcgtggtggtatgcgcttatagtcccagctacttgggaggctgaggcaggagagtcacttgagcccaggagtttgagaccacagtgagccatgatcacaccactgcactctagcctgggtgacagagcaagaccctgtctcaaaaaaaaaaaaagacctgtgtacctttggaattaaaatgacttctcatttagacagcacaagcacaatcatgtcatttcaagaatctggtttaaacacactgttgttttattttgcagctgggtagaacatggttgaggctaatgatgccaacaaccataagttcaattatcttggtgttaaaaatgtgtcttttggccatttaggtgcacatgaatgaactggaacaaatattactgttgctggaagtcttatagcaaacccatttgaaagcatttatggtagctgtgacagaattaattattattattttatcattatttgagacagggtcttgctgtgtcacccaggctggagtgcagtggcatgctcatggttcactgcagccttgacctcctggactcaagtgatcctcccccctcagtctccctaataagtaggatgaccgttgtgcaccaccatgcccagctaatttttgtacagacagggtttcgccatgttgcccaggctggtctaaacttcaagcaatcaatccgcctccacctctgcctcccaaagtgctggaattacaggcatgagccaccacgcctgggcagaattattattaaatataattggttacctgatggattgtagaatggattaatgatgcttattgaaattcaggccgggtatggtggctcatgcttataatcccagcactttgggaggccgaggaaggaggattgcttgaggccaggagttgaaggctgcagtgagccatgatggtgccaccgcaccctagcctgagtgacagagcgagaccatgtctgaaaaaaaatagtataaaataatactaattaatccctgaagaagttgacataaaaataaagtaagggaaataagatgggtcagagataagtgttttaaaaatgaaagctcagaccagcatggccaacatggcgaaatcctgtctctaccaaaaatacaattagccaggtgtggtggtgcatgcctgtagtcccagctactagggaggctgagacaggagaattgcctgaacctgggaggcagaggttgcagtgagcgagatcacggccaccgcagtccagcctgggtgacagagcgagactccatctcaaaaaaaaaaaaaaaaaaagcaagctcaaaggtcctaagaataatttttcccttgaattctgatgaggaattatcatctgatgcaatcactatcgtttgtatataatatatacagtagaggccaaaagcaatcttgtaaggggctaaaataatgctaagaatgatctctggtgatctggcttgatagaaaagaaagcagagttcttttaatatttctgtgtgggcagtacattcatatggtttgaaattcaaagaaagaaaaataatgaaaagcctcttttttattttgtttcttgcaatcagtttcttccccatatacaactaatgtaaaatgtcttccagccatctattttatgcctccataataaatatatgtatgtgaatatattctttcccttattttaaaaacataaatagtaaattaaaggcaatgttctgtgccttgttttttctactagtatatcttggcattttttaacctattatatgttgtttcctcatttttttttttagctgcatagtcttccgttatgtaaatacaccataatttatttaagccgtcctctactcatggactttcaggtttccttttcttttgcacacaccttgttcatgtcatttcacctactcatgagtatatctgtaatgtaaaatacttcgaattgaaatcaatggcataaagggtatatacatttgtaaaatttgataaatattgacaaataagaggttgtacctttttatactcccagcaataatgtacgaaagtgtgtgtttctccacagcttttccaacagttttaatatttttaaatctttgccaatttgttgggtgaaaatgtacaatatactgtacatattaaaagaatacacatttgatgagttttgacatgtatacacctgtgaagccatcactacaatcaacttaacatattcatcactctcaaaagtttccttgtgccttttgtaatccctcccttcttttctcttccccactcctcctaatttccagggagccactgctctgttctgccactgtagattagtttgcttatgacttgtatttggaatcctacagtatatacttttgttgtttggcgtttagcttatttatttatttatttatttttttgagatagtcttgttctgtcatccaggctggagtgcagtgacacaatcatggctcactgttgcctagatctctgggctcaagggatcctcttaggctcaagggatcctcccatctcagcctcccaagaagctgggactgcaggcatgtgccactgggcctaattttttttaaatttattttcgtagagatggggtctcactatgttgcccctgctggtgtcaaactcccggcctcaagcagtcctcttgctttggccccccaagctgttggtattatagacatgatcaatgttgtgtatatcaatagcatatcctttttattgctgagtagtattccattatatggatatatcagtttgtccatttacctgttgatggatattttgatagtttccagtttttggctattaacaaagctgctaggaacattcatgtataagactttacatggacatattcttgggtaaataggaatggaatgggtggatactatatggaagtgtatttttaaaagaaactgccaaactgttttgccaccagcagtttacatctccatcagcagtgtttgagagtttcagttgctccacatcaacttttttttattttttatttttatttttgtgaggcagtctcactctatcacccaggctggagtgcagtggtgcgattatagctcactgcagccttgaccttggactcaagccatcctcccatctcagcctcctgagcagctgggagtagctaggaccacaggtgtgtaacactatgcccagctaatttttcaaatttttttgtggaaatggggttttgccatgttgcccaggctggtcttgaactcctgggctccagtgatcctcccacttggcttcccaaagtgctgggattacaggtgtaagccaccatatctggccaacaagttttttttttttttttttttttttttttgagaaggagtctcactctgtcacccaggctggagtgctgtggcacgatcttggctcactgcaacctctgcctcccaggttcaagcaattcttgtacctcagcttcctgagtagctgggattacaggtgtgcgctaccatgcctagctaatttttgtattgttagtagagatggggtttcaccatgttggccaggctggtctcaaacttctgacctcaggtgatccacctgcccctgcctcccaaagtgctgggattacaggcatgagccactgcgcctgctcaaaatttttatttttatgtaatcaaatgtgttgtcatttgctttttggtttctggaatttgtgtcatactcagaaagatcttccttactttccaaaaaaattcttaccacagtattttttttttttttttttttgagatggaatctcaccctgttgcccaggccagagtgcaatggtgtgatctcggctcactgcaacctctgcctgccaggttcaagtgattctcctgcctcagcctcccaagtagccagcattacaggtgtgcaccaccatacctggctaattttgtctttttagtagagacagggtttcaccatgttggtcaggctggtctcaaactcctgacctcaagtgatcccacctcagcctcccaaagtgctgggattacaggcgtgagccactgcacccagccaacacagtatattgttatatatataattttttttagaaacaggatcttgcatgcagtggcttctcacaggcatgatcttagtgcactagacccttgaattcctgggctcaagcaatcctcttgccttggcctcctgagtagttgggactgcaggtgtgcaacaccatgcctggctattctaatattttatatctaatttttacatataaatctttgattcagattcaggtccttttttccccacgtctcaacactattaatagatttgagattctaaattaaattaattaaattcttttttttttttttgagacagagtcttgctgtgttgcccaggctgaagtgcagtagtgcagtagttggctcactgcaacctacgccatctgggttcaaatgattttcctgcctcagcttcttgagtagccgggactataggcatgtgccaccatgcccagctaatttttgtatttttagtagagatggggtttcactatgttggccaggctggtctcgaacgcctgacctcaggtgatctgcctgcctcgacctcccagtgttaggattataggtgtgagccaccgtgcctggccacttaattaaattcctatacataaatgggactatttctcaacttcttacttgttgatttgcttatttatgtaccattttaatatctgatagagctaattcccacttgttgatacaggaatttcttaagctggggtctgtgtatatgagtttgtgggagatgagggaagtctgtgaatccaatgaaatacacatttataattgtggttgcaatgtgatcctttctggggaagaatccgtaatttcattagattctcaaaaggatgcatgactcaataaatgttgaaccacagatctagaagaataatagaggcttatatccttaaggcagtccctcatgagtgttaatctttttaaatcaaattttgttatgaagtgtggatataagtaattgcttgtgcatacgtagaataatatctggaaaacgcatgagaaattgataacattggttgtcagaagatgggaactggtggtggttgaggaacaaaggtgggagggagacttcgttactttcttatattgttggaatttggaaccttatgattgtattaccttttccaaaaagtgcataatattttaaaaattaaggtgaccaactggataactcttcaatagtgtctctagaatgatctctgtggaaaaggaacaattcttggttatttcttactggctttttttttttttgaaatggagtctcactctgtcgcccaggctgaagtgcagtgacactctgcaaccttcggctcactgcaacctttgcctcctcggttcaagcgattctcctgcctcagcctcctgagtagctgggactacagtcgcatgctgccacgcctggctagttttttttttttttttttagacggagtctcgcctatctgccaggctggagtgcagtggtgcaatctcggctcactgcaacctccgcttcctgggttcaagcaattcttctgcctcagtctccccagtaactgggactacaggcgcataccaccacaccctgctaatttttgtatttttagtagagatggggtttcaccatattggccaggctggtctcaaactcctgaccttgtgatccacccaccttggcctcccaaagtgctgggactacaggcgtgagccaccgtgcccagccctagtttttgtatttttagtggagatggggtttcaccatgttggccaggctggctcaaattccagacctgtagtgacttgtccacctcagcctcccagagtgttaggattacaggcatgagccaccgcacctggcctctcttcctagcttttttatattactagacttaatgccagagttctttgccaggtcaccttccaaaccactgccaattacattacttctgaatctcatttctttgcagaagtaaaaaataaacttgcaagatggttgtatggattaaatgagataatatatgtaaaacatttggcacaagtgttagttccttttctcaacataattttttctctttatagggagtctgaagatacagtattgctcgtcctcaaagagatctaccaaacccagggtatcttccttgatcagcctttacagtaaaaatgacccatctatggctgcttaatgtaagttttaaaatgtcatatatatagtgtaattcttacatattaacatgttataatgaactatggagcctcaagctctttttaaatatactagctgttgcctgtcaccaagatctaggctgctattcatttttagagggactggtagaaattcatggggaaaaaaacacagtagcccatttagaggaagattagtgtatgtctgttttgctagagattttgtccaatgacacctgtcattttttaggatctaaactcagagttttaatggttctgttatctaagagttactgtggcaacagttatgattttaattaccaaccacccatcctgagatttaaattactcagccttttagatgtgaaattacaaagtctgtgtattcgactctggcattctctgtggttgccttccagttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccata

SEQ ID NO: 594 - DNA, 30817 bp, Homo sapiens
ggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgaggtaagtctgtgtggggaaaaggacaatggagccgaaagccggcgtctgccgtcccgccgggcccgcgcgagatgccctcctgccccccgccctacgaggcagcttagaagtgtccttctggtgcctgcggcgctgatcgttgccgagtggaaggagtgttggagaggtagaaacagctggtcagagccgcctctgcgggaggaggcttttgaggtcgcttgttagctttcatctgagattctggctatgggagtgggcgtgcgtgtgcgcaccgtggccccaggcgaggtttcgtcttttcccaatttgtaccaccacccattaagcgacttcaaggatccatcaaaaatgattggttcctaagcgaacagttttattttttgtattttaagattccattagttgtgtaatggtaggggcctggagcccaaaaccttggcgttactaggacagggcatgacccagctgacttggagtaaattttctgcctttaactacatttagattggaaattagggtaaaatgtttttgttgcaatctagtttcgagcatgtggtcctgtgattctgggtttgttttataacttatggactgagtaaaattacccagtttactgagagaattgagaactctgtgcaatggttgatctaatagaagcattttatttaaagcttccacccatccagttgctaatttatgttatttctcttttaaattatgtagattttgttgttgttgttgttgcagaaatggctccgtaaaatgattagttttgtgcgtgtgtgtgtgcgaacagttacacagttaagttcgttttcctgatagttttcttttgtctttagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggtaggtgaaaattatgacttggaatagacaaagactctcccctcttcaaactataatataatggtccttatagtgagtgctatgaaaaccaaattttagatttttccagttacataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcacacctgtaatcccagcactttgggaggccaaggcgagcagatcacttgaggtcagagtttgagattagcctggccagcaatggtgaaaccccttctctactaaaaatacaaaaattagctgggcggcggggtttgtgcctgtagtctcagctacctgggaggctgaggcaggagaattgctcaaacccgggaggcggaggttacagtgagccaagattgtgccactggactccagcctgggtgatagagtgagacttgtctcaaaaaaaaaaaaagaaaagaaaagaaaaaagtatgtatagagtggggtgcagaagaatgaactctctaacttgtcacttgtcttttcttcttttataaaacaagaatgattctatttatactgaatcatcatgatggttattaatttaccttatggttcctcaagcaaattcagaaaaatcacattatataatttttttaaggggcactgctatctttccccagaaaaagaacaaaactgggtagtatttttttcatatttcattaaaatcaggaatggttttgacggtttgtaaagtaggtagtgaaaaagatatgaattaaattccattttgtttggtgtttagtcaagtaggaacttttcattcatgtgtttcataacattatttagagtataactgagaattgtatgttgggagatttattttgaaatatgtacttcttttccccttttcaatccttgaaaggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggtattcttttgactctttttttacttattctttctttctcttatttaataatcttttctttcctttgtaatttattttgtgaaatttccagaaagactttggttctgtctgcatcacattataaaacataataaagcatttctatttacaagcaagtttcaggataaagtagtcttattttcagattttttttttttttttgagacggagtctcgctctgttgcccaggctggagtgcagtggtgcgatcttggctcactgcaacctccacctccccggttcaagtgattctcatgcctcagcctcccaagtagctgggattacaggtggccgccaccacacctggctaattttttttaaggggcactgctatctttcctcagaaaaagaacaaaactgtttgggtagtattttttttcatgtttcattaaaatcaggaatggtttgacggtttgtaaagtaggtagtgaaaaagatatgaattagattccattttgtttggtgtttagccaagtaggaactgttcattcatgtgtttcataacattatttagaatataactcagaattgtatgttgggagatttattttgaaatatgtacttcttttccccttttcaatccttgaaaggaaaatattgtaatgggagagttgttcctactgatttttattagagatggggtttcaccatgttggctaggcttgtctcgaactcctgacctcaaatgatctgctggcctcggcctcccaaagtgctgggattacaggtgtgagctactgtgcttggcctttttcagattttaaaatacgatggaaatggttgtggtgttttaaggtgtaaaaaaagaaaaaaatactccgggcctggtggctcacgcctgtaatcccagcagtttggggggctgaggtgggcggatcacctgaggttgggagtttgagaccagcctgaccaacatggagaaacctcgtctctactaaaaatacaaaattagctgggcacggtggtgcacgcctgtaatcccagctacttgggaggctgaggcaagagaattgcttgaacccgggaggtggaggttgtggtgagtggagatcgcaccattgaactacagcctgggcaacgagcaaaactccatctcaaaaaaaaaaaaaaaaactggtgggcacagtggctctcacctgtaatcccagcacattgtgaggccaaggcaggaggatgacttgagcccaggaatttgagaacagcctgggcaacaaagcaagaccccaccactacaaaaaaaagtacacgcgcacacacacacacacacacacacacacaaatacaaatgcaaactgtattatgctatggtcacaggattgatcttttttagcttttatttttcttgctctgaaaactgaaatttttctttaaattggagtagagcgttagtattttttgttgttgttgaaacaagagtgtcgttctgtttcccaggctggagtgcagtggcacgatcttggctcattgcaagctctgcctcctgggttcttgccattctcctgtctcagcctcccaagtagctgggactacaggcgcccgccaccacgcccagctaattttttgtatttttagtagagacggggtttcaccgtgttagccaggatggtctcaagctcctgacctcgtgatccgcccgcctcggcctcccaaagtgctgggattacaggcgtgagccaccacgcccagcctttttcttgtttttggttttttttttttgctttttttgtttttgtttttgtttttgtttttgagacagagtctcactctgttgcccaggctggagtccagtggtgcgatctcggctcactgcaacctctgcatcctgggttcaagcacttttcctgcctcaccctcctaagtagctgggattacaagcgtgcctcaccacactggctaattttttttttttgagacggagttccactcttgtttcccaggctgtagtgtagtggcgcgatctcagctcaccgcaacctctgcctcctgggttcaagcgattctcctgcctcagcctcccgagtagctgggattacaggcatgtgccacaatgcctggctaattttgtatttgtagtagagatgggatgggatttcttcatgttggtcaggctggtctcgaactcccaacctcaggtgatccacccgccttggccttccaaagtgctgggattataggcgtgagccaccgcgcccggctcacactggctaatttttgtatttttagtaaaaatggggttttgccgtgttggccaggctggtctcgaatgccagacctcaggtgatcttcctgccttggcctcccaaagtattgtgattacaggcatgagccaccacgcctggtctagaacattaatattaatatattaaaatgtgaacactaattatctagcgtagatgatggaattaggagtatttttccccctttgtcctggtgctactatcagttgtaatttcaaaataatttaaaaataggctgggtgctgtggctcatgcttgtaatcccagcactttgggaggccgaggcaggcagatcacctgaggtcaggagtttgagaccagcctagccattatggccaaaccccgtatctactaaaactacaaaagttagccgaatgtggtggcgggtgcctgtaatcccagctacttgggagactgaggcaagagaactgcttgaacctggggggcggaggttgcagtgagccgagattgtgccactgcaacccagcctgggcgacagagtaagacaaacaaaacaaaacaaacaacaacaacaacaaaaagatttaaaaataaatttgataaattggagtaggatattcttattgaaactcattaatacatagtattcttgttaataggttcagtttaataggaaagctactagagaactctaatgaaatgtgttttcttttaaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttcttgtctcttggacaaaatcctagctttactgtaatttaaaaagatgagtttaaaatttcaggctttaaaaacataccaaacattgataaaaatgaaatactagataaaagtattttatcaatgttcagttgcctggattcaataactgtattatggttatgtaagataatatacttaggaaatacacattatggtattaaagggttaaagaggtatggtgcatgcaacctgatgatgtatgtagtctgctttctaatgattcagaaaaataaatgtgtgtgtgtgtgtgtgtacacacacagagaatcataaagcaaatgtaattgttaaaaagttgaatctctgtaaaaagtatgtgggagtgtctgtactatgctttctagttttctgtacatttctagttatttagaaataaaaagttttaaaaacctggctgcacgtggtagctcatgcctgtaatcccagcacttggggaggccaaggtggaaggatcacttgagcccaggagttcgagaccagcctgggcaatatggcgaaaccctgtctgtacaaaaaatacaaaaattaactgggcatggtagcacacatctgtagtctcagctattttggaggctgaggcaggaggatcactcgagcccagaaggttgaggctggaatgagtgtttatcatgccactgcactccagcctaggcgacagagtgagactctgtctcaaaaaaaaaaaaaaaaaagtttttaaaacctgaaaaaaggccaagtgtgttggctcacggctgtaatcccagcactttgggaggctgaggcgggcgggtcaggaggtcgagaccattctggctaacacggtgaaacaccctgtctctactaaaactacaaaaaattagccaggtgtggtggcgtgtgcgtgtagtcccaactactcgggaggctgaggcaggagaatcgcttaaacccgggaggcagaggttgcagtgagccaagatcgtgccactgcactccagcctgggtgacagagcaagactctgtcacaaacaaaaaaaaaaccataatttaaaaaaaaaaaaaaaagagtttttttttttggagacagagtcttgctctgtcacccaggctggagtgcagtggtgtgatctcggctcactgcaacctctgccacctccagggttcaagtgattcttctgcctcagcctcgcgagtagctgggattacaggcatgtgccaccacacccggctaattttgtatttttagtagagatgaagtttcaccgtgttggtcaggctggtctcgaactcctgacctcatgatctacctgccttggcctcccaaagtgctgggattacagccgtgagccaccgcgcccagccgagttttctttttcagagatcagaaaaaaaagaaaaaagtcctgaaaaaaattttacagacttatttcaagataaattagaaaccaagtaaaatcagtgtatttttgctaggtacttaaaggactattttgtatcttttaaattatctgttcatcttttaacttgctcatatttataaccttttcatgatgaatgatattagaatacatgactaattatacagaataattttctttttaatttcatttataggagaacctttacaaatagatcacttggtttttgtagtccatgggattggaccagcttgtgatctccgctttcgaagcattgtacagtgtggtaggtttgcaaagcatgtgagagaatattaatcagtgctcttgtgagctgagataaagccttgtctttggtctattgtcttagctgcataagaagatttggagagttaaagacaggtggcaaggtagtaaagcttctcagcttagacctgaagtgctaggaaattcctgagtctaatagtttatactcttaactattgtaatagtctcaaatgaacaagcagttaatccctataaaattgtgttttatgatgtggtggtcctatttctaactatttcaaatttacagggaaccataaagatgatagagtttaatgaataacagaagcatcaatcatttttgtaattcatactgtgataaacctttgatattgtaattggaggatttaagtcattagtataactagattttgaaaggtgtcctctaggctgggtgcggtggctcacgcctgtaatcccagcactttgggaggccaaggcaggtggatcatgaggtcacgagttcaagaccagcctggccaagattgtgaaacgctgtctctactaaaaatacaaaaattagccgggcgcagtggcaggcgcctgtaatcccagctactcgggaggctgaggcaagagaatcacttaaactcggagggcagaggttgcagtgagccgagatcgggccactgcactccagcctaggcaacagagtgagacctcaaaaaaaaaaaaaaaaaaaggtgtcctctaaaacctgatagtattcaaagtttaattgttccaattagggtgtcttattctaactggctaatggttctaaacataaactagaattgtattgtggaaggttgagactgatgtgatatgaatttcaaacaacagtgtatttttttttctttaaagtattgggtggtgcttgtttataagaaccagaaagttagggtaggaattcaactgcaagactgttgttatattgtcatgtgattaaaaaaaaaatgaaacagttctcatgatgccgacgttttgaagtttagctttctttttttttccttttcctttttttttgtttttaaatatattattttctttcctgagacaagagctttgctctgttgcccaggctggagtgtagtggtgtaaactcagctcactgcaacttctgcctcccgggttcaagtgattatcctgcctcagcctcctgagtagctgggattacaggcgcacaccaccatgcctggctaatttttgtatttttagtagatggggtttcgccatgttggccaggctggtcttgaactcctggcctcataaaatccacctgccttggccccccaaagtgctgggattacaggcatgagccactgctcctggcctgaagttagccttcttttgatgaaatattttgtatggtaaaagcaagttgttaggccaggcacggtggctcacacctgtaatcccagcactttggggggccaaggcaggcagatcacctaaagtcaggagttcaggaccagcctggccaacaggacaaaaccccatctgtactaaaaatacaaaaattagctgggcatggtggtatgtgcctgtaatcccagatcctcaagaggctgaggcaggagaattgcttaaaccagtgaggtggaggctgcagtgaggtgagatctcgccactgcaccccagcttgggttacagagcagtactccatctcaaaaaaaaaaagttattaaagaaacatcttttcctatatgcattcataatttttcctgaataccactttatttttgacggaagtcagtatgtgttctgtgcaaatgtagttagagtataattacatgatttgttgcatccagattctacagatttgttacttcattgttgatgcataagttaattttcttttccagttaatgattttcgcagtgtttccttgaacttgctacagacacattttaagaaagcccaagaaaatcagcagattgggagggtagaatttcttccagtcaactggcacagtcctttgcattctactggtgtggatgtgtgagtaatacttaataccttcgagttgttagctgtgattatattttctgatcattgctatgcttggggacgtttttatgctatagctgactgaatatttaaaatttcttagagatatgctattaaatgctgatcagtcccttggtttaattagccctggttaggagtggagagctgtgtgtatcttcagtatgttttactggctcactagtatttactgttacagcttcattgtatctttagcattaaagccaaatattgctatcttcccatagtgtataaccatttccatcttcagatgtcaaaagctagccataccccaagatgtacaaagtattttgttgttccttttgttattatatttaaataatatttgtccaaatttagaaaaaaggggggatttctcaaacattaaactactagcatttaaaacttgaggtataattggtacagtgacttttaagtgatggctttcttaaggtacaagaccattagttttgtttgtaaattttatggtaatgacagagaatgttgcttaaattgaggatatctagctatggggctctccagcaagtagtgtgtttctaatgtagttctagaatagaaccaggagatgcaggaagtagtcagcattgtttccatgctggtctcagaaatggcttttctgattctgtgtctcagttctcagtaccctgtgatttgggtatattctgtttgccaaacactgtggtggggtccggattcttcaatatttgagcagatgctaagaggttactaagggcacgtagcccttataaattgcagaagtggttgaatatttgaggaatctttctgggaattttaagaaacctttaactggatgttagattttgtcagcgtggtcttcctctcccagatatgaattctgtttgcttttggcacctggcactcacacctttttctgcttttagaaattgtgcattgagagagggagctgatctctttatcgtttgacctgtaattaaaaaaccttactgctgagaattccaggaaaagccttttacattttttgttttgtctttttagaaaacttttttttattagagataattttgttcacagaagtagtatatatgatgaatccttgtatactgattacccagccctaacaagcctcaacacatggctggttctgcctcaaccgtatcttcataccttatctaatgccccttcatcaccatatgatttttatcttagacatcctgtaatttcatctgtaaatgtttcagtttgtatcttttttttttggttggagtgcagtggtgtgatcacagctcactgcagcctggacctccctgggctcagatgatcctcctgccccagcctcccaagtactgctgggactacaggcatgtggcaccacttgcagctgattttttttatcttttttttttttttttgagatggagttttgctcttgtccaggctggagtgcagtggcgtgatctcagctcaccgcaacctccgactcccgggttcaagcagttcccagtcttggcctcccgagtagctgggattacaggcatgcgccaccatgcctggctaattttgtatttttggtagagacagggtttctccacgttggtcaggctggtctcgaactcttgacctcaggtgatccgcccgtcttggcctccccaagtgctgggattacaggcgtgagccaccatgcctggcccaatccagctgatttttctattttttgtagagatgggcttttaccatgttggccaagctggttttgaactcctgggctcaagcaatctgtctgctttggcctcttaaagtgctgggattacaggtgtgagccacagtgcctggcctgaacagtatattttattttttattttatttttgagatggagtgtcgctctgtcacccaggctggagtgcagtggcacggtctcggctcactgcaacctctgcctcctgggttccagcaattctcctgcctcagcctcccaggtggctgggactacagtcatgcgccacaatgcccagctaattttcgtatttcttagtagagacagggtttcaccatattggccaggctggactcctgacctcatgatctgcccgcctcagcctcccaaagtgctgggattacaggtgtgagccactgcgccggcctgaacagtattttttttgttgttttttttgagacagagtcttgcactgttgcctgggctggagtgcaatggcacaatttcggctcactgcaacttccgcctcctgggttcatgtgattctcctgcctcagcctcccaagtagctggggtaaaggtgcacatcaccacacccggctaattttttgtatttttagtagagacggggtttcactctgttggacagactggtctcgaactttggacctcgtgatctgcccgcctcagcctcccaaagtgctggcattacaggcgtgagccaccgctcctggccctgaacagtatattttaaaggacttaaaaaatgtataaccataacactattatcacacttaaaaatttcttaatatcatcaaatacctagtctgttcaaatttccagttgtctattatatttttatacatattttatacatatttttatatacattaattatataattatatacattaatttttgtatacatatttatataattacaaacatgttttaaactgggatccaaataaagcccataccttgcaattagttgatatgtcttttattataagtctctcttgggctgggcatggtggctcatgcttgtaatcccagcactttgggaggccgaggcaggtagatcatctgaggtcaggagtttgagaccagcctggctaacatgacaaaaccctgtcactactaaaaatacaaaaattagctgggcatggtggcacatgcctgcaattccagctatttgggaggctggggcaggagaatcgcttgaacctgggaggcagaggttacagtgagctgagatcgtgccactgccctccagcctgggcaatagagcgagagtctgtctcaaaaaaaaaaaaaaagaaaagtctctttaatttattttcttgattaccacttacctctctgtctacatctgttgttttcttgcagtttatttatggaagaaatgggtttgacttgagggttttttatactctgaattttgcttatcacattcctctggcttcattacacatgttcctttgtcctctttttgttttttcctataaatcgacaattgtttgttataaaatgtttaagcttgaaggcttaaaattggaagcagctattaagtgtatttaggtttcctgcttatattatttttccttttttcagagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggtaacaaaatgagttctgtgtgaccagagaagactatcacattttaaagacacctgtttttgaagcacaatgtcttttatcagtatgaaattcagaggtctagaagtggtctgtggtcaggaaatttggaaggggttggaagggtggcggtaaattggaaagaaagactccttgctgtatagatttgcttacatatgtaattggcttatgccttttttgtataacagagagccatttagtgctaatgcttagaaattgtcccttcttctattttacttataggttcgcttatattgtttgatatcctaacaaatcagaaagattctttgggggatattgacagtgaaaaggtaatttagatgttcagctaggttttcttgtagttttccttagtaaggatttatagattttagacttattttttgtttttagctgagtttagtttcatgtcatgacattacatttacacttattttcattttaacagacttttaattatctctgtcattcttggatgatagaaggaagatagtaacatgcttctacaaataataattgttatattctaaaccatagttatcttattttcttttgtgaatatgcaccactggctgggcgcggtggctcatgcctgtaatctcagcactttgagaggctgagactggtggatcaccttaggtcaggagttcaagaccagcttggccaacatggtgaaaccccatctgtactaaaaatacaaaaattagctgggcatggtggtgtgtgcctgtaatcccagctacttgggaggctgaggcaagagaatcgcttgaacctgggaggtggaggttcagtgagctgagatcgtgccactgcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcactgttttcctaatttcttaagcactgagctcccttaaaattcagcaaatgtttgttaatgatgatgaatattttactaatttctttaaaaacatattttcaattgaagttgcaaaaccttggaacctcttaatttatatcttgcataaatgacaatttgttaaagttaagatacattgctgtggaaatctatgtatttctttactgcaaaatagtattaaaggaaactaaatgaatttcaagaatatgagctttataatttaatttttaggattcgctaaatattgtaatggatcaaggagatacacctacactagaggaagatttgaagaaacttcagctctctgaattctttgatatctttgagaaggagaaagtagataaggaagctctggtaaaaataatcttttaaaactttatgccaagccattttcagtatttttgtttatcgtgtttactaagagcctaccctttagacactttttagtcataaatactttatgattaatgttccttagcattatttatttgctttttatcatatcaagtgacctttgctttgtggaagttcaaaggtcagatggccatattgatattcatagagcaatggagcagactaaccagtacggctcatagaaaacatgagtgcaagaacaaacaaataaataaccattagctattccaactctaattttctgttgtactttcaagagctctactgttatttgcgagtagctgggattacaggtgcccgccaccacgcctggctaattttgatatttttagtagagatggggtttcactgtattggccaagctggtctcttggccaggctggtctggaattcctgaccccgtgatccacccaccttggcctcccaaagtgctgggattacatgtgtgagccaccgtgcccagccagctgatttgtttttttttttttttttccatttttgtcgtgcctttttctggtttgtgatacattcactcatttaacagatatttagaaaatgcttactataccaagtactggatagactggtgaataagacatatgatccctgacctcatagtgtttatagtttactggggaagacacatgttaaataatcacacacatcatggcaattacaataagtaagtaggaaaagtacaccgtgttgtaagaattaacctggtctcataaggtgcaggaaggcttccctaatcaaatgagtgatagctggctgggtgtggtggctcatgcctgtaatcccagcactttgggaggccgaggtgggcagatcacgaggtcaggagttcgagaccaatctagtcaacatggtgaaaccctgtctgtactaaaaatacaaaaattagctgggtgtggtggcacacacatgtagtcccagctacttgggaggctgaggcaggagaatcgcttgaacccaggaggtggaggttgcagtgagctgagatcacaccactgcactccagcctgggcgacagagcaagactccatctcaaaaaaaaaaaaaaaaaacgatgagtgacacttgagatcttgattgttagtctgttccatacttgtgtgtttgctgtatgttctcagtgcttgcgttcatcagcaggagtataatccttctcaggcatgtgacatctaagtcagtatagaaatcaaggaagtttttttgttttgttttgtttttttgagacggagtcttgctctgttgcccaggctggagtgcagtggcgcgatctcggctcactgcaagctctgccttccgggttcacgccattctcctgcctcagcctcctgtgtagctgggaatacaggtgactgccactgcgcctggctaattttttttgtatttttagtagagacggggtttcaccatggtctccatctcctgacctcatgatccacccgcctcggcctcccaaagtgctgggattacaggcgtgagccaccgcgcctggccagaaatcaaggaagatttttatgtcctgaagtccttagatacccaacttctctgttttttttttttttttttaacaataacaatgtctatattattgtaacattgatattataagtattgatattttctattcttttttaggctgtttcatgaataaaacaggtccttttttctggaagttattctatgatgttttactactagagagacaggcagcaacagagtgcctaggccttgttcctcttaggggacaggattgattttattttgtctagaaataagaaagacttgattttctatgcctaggctttatgtacagaccgagatcttcaggaaataggaattcctttaggaccaagaaagaagatattaaactatttcagcaccagaaaaaactcaatggtatgtgcctaatacagcttgttggactaaacaattctttgatgtccatagtgtgtccttgtgctttgtgggatgtttactctggggagccaagcagttttttggtaattgatctttggctctttttttttgagacagggtctcgctctgtcactcaggctggagtgcagtggtgtgatcccagctcattgcaacctctgcctcccgggttcaagcgattctcctgcctcagcctctcgagtagctgggactacaggcgcccaccaccatgcctggctaatttttgtatttttaatagagacggtgtttcaccatattggccaggctggtctcaaactcctgaccttgtgatctgcccgccttggcctcccaaagtgctgggattacaggtgtgagccacccgcctggccgatctttggctctctttctagaaattaaacacattttcttttttacattcttttttttttcttttcctggaaatgaaatctcgctgtgttgcccggggtggagtatagtgggtggtctcggctcactgcaacctccaccttccaggttcaagcaattctcctgcttcatcctcttgagtagctgggattccaggtgtgcaccaccatgcccagctaactttttgtatttttagtagagacggggtttcactatgttggccaggctggtcttgaactcctgacctcagatgacccatgtgcctcagcctcccaaagtgctgcaccgctcctggcccttctttttttacatccttaaaagtattattagcttcagaagtcttctctcctctggaattctcctaccatttatttatttatttattttttgcttttttcttttcatgagagttttaccaatatctacttcacatcacataccataaaattcacccttttaaagtttacaatttaatggtttttagtatattcatagagttatgtaaccattaccactatccaatttcagcacatttccattgtcccttagggaaaccccatacccatttgctgtcactccccattgctccctgcccccagcctctgtcaaccactaatctactttctgtttctacagatttgcttattttggacattccatataaatggaatgtccttttgagccatgtgtctgacttctttcacttagcataatattctgaaggtttacctgtgttaacagtacttccacattcagtttttctggtcactgaatttctaactccatatcttattagttagtttttttctttttgagtcggagtgttgctctgtcgcccaggatggagtgcagttgcacgatcttggctcaattgcaacctccgcctcctggattcaagtgattctcctgcttcagcttcctgagtagctgggattacagacacgcgacaccacacccagctaatttttgtatttttagtatggggtttcaccatgttggccaggctggtcttgagctcctgacctcaagtgatccgcccacctcagcctcccaaagtgctgggattacaggcgtgagccaccatgcctggccagtagttagttcttttccaactttttagcaggtggctcatttctttttaaagactcagttcttggcccagcccatcgacatcctacttcccttgattacagaggcacagcacttcatagaactctagcaatcctcagcattatcttcccacagtgccctgctattgttttctcttatgattgttgcctaaagtttcaacgctactgaaatggctatgtacaactttcatcattttagagcatctaagaatgtcaattaacaatttaaggcaataatttaatcttgttttctgaggaaatcttcctagaatttttggctgccatttcagaactttcccaagggtcctttcaaaccagtagaaaactatataatcctttggctatacttttactatatagtagctccccatactttttttttaaatagagactatgttgcccacgttggacttgaactcttgggcttaaacaatcctacctacctacctacctcagggtcctgagtagctgggactacaggtgcatgccgtcatgcccagcttctccacataactattttttattctttagggtattaagagaccagccccgcagcctgcttcaggggcaaacatccccaaagaatctgagttctgcagtagcagtaatactagaaatggtgactatctggatgttggcattgggcaggtaactaattctctttgatcattttacagcctgctatttgtatggtagaaacagatgtaacttttgttattaatgagagatgcttttattttcctcctttgaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcaccctgtaagcattgtacagctattgtggttttacctaaatatcagggcttattgttaaagaacataggattttctgttgtgttgatttttttttcctattccattgtctagcaatgagacaacttataatagtattgatttggaagtgatggagcagaactgtacatttttttaaatgaacttatgattattgtttaagatacatagttctggttgtacatggtgactaatgcctgtcatcccagcactttgggaggtcaaggcaggaggattgcttgagcctaggagttgaaggctacagtgagccatgattgcaccactgcactccagcctgggtgacagagcgagacctcatctcaaaaaaaaaaaaaaaaaagttatatagtttccagactgtgcttagcagaggtaaatgtagctcttgtttttcctatgtagtttgatcctgtggcctataggattgaaccaatggtggtcccaggagtggaatttgagccaatgctgatcccacatcataaaggcaggaagcggatgcacttaggtaagtccgagcatagaacttgataattctagaccttttggccagtgcaaagggcatcattcactctgttcagctatgttggaccctaagctctttgtaaatcatttaatgttctttatttatatgtttcagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtggtcagtgacactgtacacattgaccagctgccagataagagggatgccatggtgtggcgtttttcatagttaatttaatttaatttcacatttaatttcatagttaatattgcattcttttgctttagttttcaacttctaaagagctctattcctgcttgcatttagtataaacccaaggcaaatgacctagctatcaatggtataggtaatgagatgtgttgcgcaaaagcaaaaaaggggattggacaaaattactgtgacctgagaaggagcttgaaggagattgagaggaggaagatgggagagagctctctgaacagagagtagctcattctctggtaaacttggagtgtgaggagaagttaacaggataaccctgaaggccaaaaggttttagattcttattatggttcttccatatccagatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactggtaaatgttgtttatttttgtctgttttgtttgtttacctgtttcatagatatttgatagatgtagaaaaaggaggataggccaggtgcattggctcaggcttataatctcagcactttgggaggccaaggtgggaggattgcttgagttcaggagtttgagaccggcctgggaaacatagcaagacctcatctctacaaaaactaaattagctgggcgtggtggtatgcgcttatagtcccagctacttgggaggctgaggcaggagagtcacttgagcccaggagtttgagaccacagtgagccatgatcacaccactgcactctagcctgggtgacagagcaagaccctgtctcaaaaaaaaaaaaagacctgtgtacctttggaattaaaatgacttctcatttagacagcacaagcacaatcatgtcatttcaagaatctggtttaaacacactgttgttttattttgcagctgggtagaacatggttgaggctaatgatgccaacaaccataagttcaattatcttggtgttaaaaatgtgtcttttggccatttaggtgcacatgaatgaactggaacaaatattactgttgctggaagtcttatagcaaacccatttgaaagcatttatggtagctgtgacagaattaattattattattttatcattatttgagacagggtcttgctgtgtcacccaggctggagtgcagtggcatgctcatggttcactgcagccttgacctcctggactcaagtgatcctcccccctcagtctccctaataagtaggatgaccgttgtgcaccaccatgcccagctaatttttgtacagacagggtttcgccatgttgcccaggctggtctaaacttcaagcaatcaatccgcctccacctctgcctcccaaagtgctggaattacaggcatgagccaccacgcctgggcagaattattattaaatataattggttacctgatggattgtagaatggattaatgatgcttattgaaattcaggccgggtatggtggctcatgcttataatcccagcactttgggaggccgaggaaggaggattgcttgaggccaggagttgaaggctgcagtgagccatgatggtgccaccgcaccctagcctgagtgacagagcgagaccatgtctgaaaaaaaatagtataaaataatactaattaatccctgaagaagttgacataaaaataaagtaagggaaataagatgggtcagagataagtgttttaaaaatgaaagctcagaccagcatggccaacatggcgaaatcctgtctctaccaaaaatacaattagccaggtgtggtggtgcatgcctgtagtcccagctactagggaggctgagacaggagaattgcctgaacctgggaggcagaggttgcagtgagcgagatcacggccaccgcagtccagcctgggtgacagagcgagactccatctcaaaaaaaaaaaaaaaaaaagcaagctcaaaggtcctaagaataatttttcccttgaattctgatgaggaattatcatctgatgcaatcactatcgtttgtatataatatatacagtagaggccaaaagcaatcttgtaaggggctaaaataatgctaagaatgatctctggtgatctggcttgatagaaaagaaagcagagttcttttaatatttctgtgtgggcagtacattcatatggtttgaaattcaaagaaagaaaaataatgaaaagcctcttttttattttgtttcttgcaatcagtttcttccccatatacaactaatgtaaaatgtcttccagccatctattttatgcctccataataaatatatgtatgtgaatatattctttcccttattttaaaaacataaatagtaaattaaaggcaatgttctgtgccttgttttttctactagtatatcttggcattttttaacctattatatgttgtttcctcatttttttttttagctgcatagtcttccgttatgtaaatacaccataatttatttaagccgtcctctactcatggactttcaggtttccttttcttttgcacacaccttgttcatgtcatttcacctactcatgagtatatctgtaatgtaaaatacttcgaattgaaatcaatggcataaagggtatatacatttgtaaaatttgataaatattgacaaataagaggttgtacctttttatactcccagcaataatgtacgaaagtgtgtgtttctccacagcttttccaacagttttaatatttttaaatctttgccaatttgttgggtgaaaatgtacaatatactgtacatattaaaagaatacacatttgatgagttttgacatgtatacacctgtgaagccatcactacaatcaacttaacatattcatcactctcaaaagtttccttgtgccttttgtaatccctcccttcttttctcttccccactcctcctaatttccagggagccactgctctgttctgccactgtagattagtttgcttatgacttgtatttggaatcctacagtatatacttttgttgtttggcgtttagcttatttatttatttatttatttttttgagatagtcttgttctgtcatccaggctggagtgcagtgacacaatcatggctcactgttgcctagatctctgggctcaagggatcctcttaggctcaagggatcctcccatctcagcctcccaagaagctgggactgcaggcatgtgccactgggcctaattttttttaaatttattttcgtagagatggggtctcactatgttgcccctgctggtgtcaaactcccggcctcaagcagtcctcttgctttggccccccaagctgttggtattatagacatgatcaatgttgtgtatatcaatagcatatcctttttattgctgagtagtattccattatatggatatatcagtttgtccatttacctgttgatggatattttgatagtttccagtttttggctattaacaaagctgctaggaacattcatgtataagactttacatggacatattcttgggtaaataggaatggaatgggtggatactatatggaagtgtatttttaaaagaaactgccaaactgttttgccaccagcagtttacatctccatcagcagtgtttgagagtttcagttgctccacatcaacttttttttattttttatttttatttttgtgaggcagtctcactctatcacccaggctggagtgcagtggtgcgattatagctcactgcagccttgaccttggactcaagccatcctcccatctcagcctcctgagcagctgggagtagctaggaccacaggtgtgtaacactatgcccagctaatttttcaaatttttttgtggaaatggggttttgccatgttgcccaggctggtcttgaactcctgggctccagtgatcctcccacttggcttcccaaagtgctgggattacaggtgtaagccaccatatctggccaacaagttttttttttttttttttttttttttttgagaaggagtctcactctgtcacccaggctggagtgctgtggcacgatcttggctcactgcaacctctgcctcccaggttcaagcaattcttgtacctcagcttcctgagtagctgggattacaggtgtgcgctaccatgcctagctaatttttgtattgttagtagagatggggtttcaccatgttggccaggctggtctcaaacttctgacctcaggtgatccacctgcccctgcctcccaaagtgctgggattacaggcatgagccactgcgcctgctcaaaatttttatttttatgtaatcaaatgtgttgtcatttgctttttggtttctggaatttgtgtcatactcagaaagatcttccttactttccaaaaaaattcttaccacagtattttttttttttttttttttgagatggaatctcaccctgttgcccaggccagagtgcaatggtgtgatctcggctcactgcaacctctgcctgccaggttcaagtgattctcctgcctcagcctcccaagtagccagcattacaggtgtgcaccaccatacctggctaattttgtctttttagtagagacagggtttcaccatgttggtcaggctggtctcaaactcctgacctcaagtgatcccacctcagcctcccaaagtgctgggattacaggcgtgagccactgcacccagccaacacagtatattgttatatatataattttttttagaaacaggatcttgcatgcagtggcttctcacaggcatgatcttagtgcactagacccttgaattcctgggctcaagcaatcctcttgccttggcctcctgagtagttgggactgcaggtgtgcaacaccatgcctggctattctaatattttatatctaatttttacatataaatctttgattcagattcaggtccttttttccccacgtctcaacactattaatagatttgagattctaaattaaattaattaaattcttttttttttttttgagacagagtcttgctgtgttgcccaggctgaagtgcagtagtgcagtagttggctcactgcaacctacgccatctgggttcaaatgattttcctgcctcagcttcttgagtagccgggactataggcatgtgccaccatgcccagctaatttttgtatttttagtagagatggggtttcactatgttggccaggctggtctcgaacgcctgacctcaggtgatctgcctgcctcgacctcccagtgttaggattataggtgtgagccaccgtgcctggccacttaattaaattcctatacataaatgggactatttctcaacttcttacttgttgatttgcttatttatgtaccattttaatatctgatagagctaattcccacttgttgatacaggaatttcttaagctggggtctgtgtatatgagtttgtgggagatgagggaagtctgtgaatccaatgaaatacacatttataattgtggttgcaatgtgatcctttctggggaagaatccgtaatttcattagattctcaaaaggatgcatgactcaataaatgttgaaccacagatctagaagaataatagaggcttatatccttaaggcagtccctcatgagtgttaatctttttaaatcaaattttgttatgaagtgtggatataagtaattgcttgtgcatacgtagaataatatctggaaaacgcatgagaaattgataacattggttgtcagaagatgggaactggtggtggttgaggaacaaaggtgggagggagacttcgttactttcttatattgttggaatttggaaccttatgattgtattaccttttccaaaaagtgcataatattttaaaaattaaggtgaccaactggataactcttcaatagtgtctctagaatgatctctgtggaaaaggaacaattcttggttatttcttactggctttttttttttttgaaatggagtctcactctgtcgcccaggctgaagtgcagtgacactctgcaaccttcggctcactgcaacctttgcctcctcggttcaagcgattctcctgcctcagcctcctgagtagctgggactacagtcgcatgctgccacgcctggctagttttttttttttttttttagacggagtctcgcctatctgccaggctggagtgcagtggtgcaatctcggctcactgcaacctccgcttcctgggttcaagcaattcttctgcctcagtctccccagtaactgggactacaggcgcataccaccacaccctgctaatttttgtatttttagtagagatggggtttcaccatattggccaggctggtctcaaactcctgaccttgtgatccacccaccttggcctcccaaagtgctgggactacaggcgtgagccaccgtgcccagccctagtttttgtatttttagtggagatggggtttcaccatgttggccaggctggctcaaattccagacctgtagtgacttgtccacctcagcctcccagagtgttaggattacaggcatgagccaccgcacctggcctctcttcctagcttttttatattactagacttaatgccagagttctttgccaggtcaccttccaaaccactgccaattacattacttctgaatctcatttctttgcagaagtaaaaaataaacttgcaagatggttgtatggattaaatgagataatatatgtaaaacatttggcacaagtgttagttccttttctcaacataattttttctctttatagggagtctgaagatacagtattgctcgtcctcaaagagatctaccaaacccagggtatcttccttgatcagcctttacagtaaaaatgacccatctatggctgcttaatgtaagttttaaaatgtcatatatatagtgtaattcttacatattaacatgttataatgaactatggagcctcaagctctttttaaatatactagctgttgcctgtcaccaagatctaggctgctattcatttttagagggactggtagaaattcatggggaaaaaaacacagtagcccatttagaggaagattagtgtatgtctgttttgctagagattttgtccaatgacacctgtcattttttaggatctaaactcagagttttaatggttctgttatctaagagttactgtggcaacagttatgattttaattaccaaccacccatcctgagatttaaattactcagccttttagatgtgaaattacaaagtctgtgtattcgactctggcattctctgtggttgccttccagttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccata

SEQ ID NO: 595 - DNA, 6089 bp, Homo sapiens
ttatttgaatatcaggtttactgaaggaaaaagatacattgaaaatataggaacatacacataaaagacaatgtcatatttaaagtataatcacaataaagagaaagggagctgtaggtcctatggcatccattctgatgacatcccataattgttccttatattccattgtgaagaaggggcagaaaaagattcatctgtccttcagatgacgatacctgtcatttttcttttctaccttagtcacttggcagtgttggtgcatttgagcagatcttcagtcatgaatggaaggaaagaagctcacaagtacagttatggtcaaatgaggtagaaacagtcatctgttagtagtgctgaaaccacactcctgaccattttcttctttattattgttttcacttagtaattcaacaaattgtttatgcccacggtgttcaaaatgcacagcagtaccagatggctggactcagataagatgcacacaaaagtgataaattaccctagattcgacattttcctatttaaggcttgatggaattgtcatcagagaaggtaaacagaatcaaagtaatttagttggccatgccctagattttaagattttgagctatatgaaatggaaattaagttttgataatgaactctagcttctgagacaaggtggggctatgtaaaggcttctttgtgacaagatccttctaagaatggcatttaaattaaatgtaaaaacactgtagatcttcagatattaatctgatagaccagattcataaggtgttggacacctttgaaagatccttttactagaacatgtggcatacagtagtggaaaagaaccgtaactcctcaagatagatgagcaggggcaaaagtgtgtaatcatttggaggcagaatacagtgtggcttatgtcctcacttgcaccttggaaggggaaaaaaaggctagaatttcttgtcttgtgcatggtccggttaggagggctagttcacctgttctctattgagatagattcaattttttttttttttgagatggggtctcactctgttgcctaggctggagtgcagtggtgcgatctcggctcactggaacctccagctcccaggttcaagcaattctcctacctcagcctcccaggtagctgggattacggcacacaactcctggctaatttttgtatttttagtagagacagggttcaccatgttggccaggctggtcctgacctcaggtgatccaccctcctcagcctcccaaagtgttgggattacaggcatgagccaccacgcccggccagattcaatttttaaatatcaaaacaataagaatccccaggcttctgtgcagtggaaagtacaagtttgtcttgaaatggtttatggcattctgcatcagtcagaggaggataatactgccgatagcagacataggcaaatgtcattccaatcatggatccaactagtacatctgaagagagtggaaacaaggtcttctcttaatattaggctcctaaatcctattacatacacatagcatagaggacctggccctccaggatactctactgtggggctaaaataacctcaattccagacttatgatttctaaataaaatctttttattctcaattttatcatagttacagtattatcattgtcaggttgctttctgaacaccaaatcaaaacacatcttaagtaagtataataagctttgttcagagtgtactaaattagaatttttctaactcagaagagtaacaaaggtccacttattgctattcatctgcccattttcaccatttaaagggtcctagaggaaggaataaagtattttaagagttgcttctcgccgggcacggtgactcacgcctgtaatcccagcactttgggaggaccaggcagatggatcccgaggtcaggagattgagaccagcctgaccaacaagtgaaaccctgtctctactaaaaatacaaaaattagccgggcgtggtggcatgtgcctgtaatcccagatactcaggaggctgaggcaggagacttgcttgaacccaggaggtggaggttgcagtgagccgagatggtgccactgcactccagcctgggcgcagagctagactctgtctcaaaaaaaaaaaaaaaaaaaagagttgcttctctttgcaaaaaactagtttatttaaaaatttaaaatagggttcctgaggacctgtgggcaatacctccagcgttttttttggaattgtgtcaggttcaagccattctcctgcctcagcctcccaagtagctgggattaaaggcgtgtgccaccatgcccagctgattttgtatttttagtagagatagcgtttcactgttggtcaggctggtcttcaactcctgacctcaggtgatccacctacctcaccttcccaaagtgctgtgattacaggcatgagccactgcacctggcctcaatttttgtatttttagtagagacggggtttcaatatgttggccaggctggtctcgaattcctgactacaggtgatccgcctgcctcagcctcccaaagtgctgaggtgtgagccaccgcgccaagccaggtgttctgtaatttggatattttacttactatagcattcagcttaaatttgtttggtttaattataattttatgttttcttgaattttacttatgtttttgaacaaaagtcctatgacaatgaacctgatttttaagagagtaaattgaactttgaggttttaaatttcctgtagatgcagtttaacttgaacttacaatgcttcaaataatggaaaaattaggatgtttatctttggtaaactctttttgtcttatctttcctataattttaaatgtacttagtacagaacccagaccatccatactcattaatttgttcattcagcagatatttagtaagcatctcctctgtgctaggtgctaggaataaaatgagtgaaatatgcaagcttccatagcctgagtactttgcttaccttgccagtgatgcttgtagtcacatgtgcgggacagtgcaatcacagctgcaaaaagtagaggtgacagaaaggcacagaacctccaagatttcccacggccttgtggtgtgaagcagtgtaacttccctgccaggtagaaggacgcaaaggccagaccagcaaatgcaactggaacaagaaaaacttttaagtggtttgtcttttaaaggaagctacctcattcatccccacataggaggctaggaagcatgagtatgtttttatttatttattttttgagacagtcttgctctgtcgcccaggctggagtgcagtggcaccatctcggctcactgcaacctccaccacccgggttcaagcgattctcctgccttagcctcccgagtagctgggactccatgtgtgtgccaccatgcccagctaatttttttatttttagtagagttgggatttcaccatgttggctagcctggtcttgaactcctggcctcaagtgacctgcatgccttggcctcccaattgctgggattacaggtatgagccaccacacccggccatgagggtgttttaatccttttttgtgtatacttatagtgtaagtcattgtgaaggaaagggaaacaaaaagaaaaatgaaggacttagtgccccaaagttaatgttttatctgagtatagttttcggtatactagctatatgtatcaacttgttgatgctttagtttcctcatctataaatgggactcataaatacaatagtccccacctcattggattattgtgagctataattaggtaagaaatgaaaatgcttcaaagtacctgacacatagaaactcttcgttaaaggtatttttattgctagtacaagattgcaggatctaggcaaataatataacaattaaatgtgcaaatctcatgaaggtaaactacctttctgttctgtaatatttacccaaatagtcaaggctcagacttgttaaactgtggagttactaaagaaggggggattttccaaattgtagaaacaagagtagtcagattttcccatccctactagctttctaggttaaattcaatgatgtgaaaacaagcatagggtagagtccatatgatattcatacaggaagaatgtccactggggaagctctttcggccctcattcaccacgtccttatcccctgtacacatcaagtcagaatgggctagcccatcagggaagcagcggtagaagaaatctgggcgtggcctggaagaaagcagcatggttggaacgtaaatcattaactccagaaattatttttcagttgtagcagacattaataatcctgttaactattggtcaaatagtgccccaggcaaaataaggtaactggcttagtatagtcaccacactaagagaaaagcctttcaaggtgagcatttaaattaggggaaaaacgcccattccagcacatgattactttttagggcaaacagcaaatgacactgcagcttcaggaggtgctcaagaggacactgaccgactgctgtggccgttggtgggaaatgctgttcaggcagaaaagagcccaggtgtcacctggaggactgaggtatggggaagggagtaagcgttgaatgacaaaagaaaaatcagagtgaagataaaggagaaaagaatgagaaagacgtgtggtggacaccattaacctctctgttctggtgggtaagggctgaggcagatgctggggtggttagctgttgtcacttacctccctacgatcagttttattgtgttggtaaagacgccattcagagccagggcaaggctggcagctgcaaagcaaagccattagttgaaaggatctgtctaggaggaaaggtatggtcatggcctcgttatgagagcagccgtgctgtttctgagatggatagaatccaaccaggcctgggcacaaaaataattagggtcctcagtgatcactcttttgtagccgagaacttttgtactaggccaaagacatttctgaggtacaaataacccagtgcatttaggcacagggctgcctgccgtgtagcctgcgtaaccaagtccctgcagtgctattttcctctcccgcggggatagagttcctttaggaatgcagaactcagtggcctccacacaggctcaccgtggctgaatcccacaacgacctcctaggttcccagcacgaagaaaccggcccgaaagggctagcgctcacccaggcaggcttgtctgctgtctcttgtgtctgccttcttgagaaatttggccaggaagatcagagacagtggagagagaaatgcaataacctgaatcagaatgtcagaggttaaaaacaatccaaaaaaaagccacactcgtgctcctacaggaaagagggatgtgacacagcaggactcactggagctaacataaggtctctgagtgcgcgtaaccgggcgccaggcagcgccaccagtgaacagcagcgcccgtgcggctcgggccccggtacctcaggctgaggcacagagcgcccgggaaaacgttgtctcagcccaaagaggctcggacaccctcctctctcaatcaggatcttaaacactcgagccctaggaggcggaacccagcgcacagcagcggagtgggcagtgggtccctacaaaggccgtctcggggtggaaaacgcacaggtgcccgcgggaagccgggtcatggggagggaggaaagacgatctttctccacgcacaaacatcggcttggtggggaaatactccgcctccacgtaggggttccggtagagccacatctcctccggctggatgagtctctggaacggggggagcagctccgtcaccctagaggggaacaaagaagcgcagagcaggtcgcctggcttcctccccgcttccccactgcccgacccgccgccccgtgccgcccgcctgcctgggaagcggggccgcccgggcccggccgtggatctttcttacaggaaggccgcgaacagcgcgagccgcacgcccacttcggccccaaaggccaccgccgccgccgccttccccatccggccgcgagctccgagcga

SEQ ID NO: 596 - DNA, 4481 bp, Homo sapiens
ttctaaataaaatctttttattctcaattttatcatagttacagtattatcattgtcaggttgctttctgaacaccaaatcaaaacacatcttaagtaagtataataagctttgttcagagtgtactaaattagaatttttctaactcagaagagtaacaaaggtccacttattgctattcatctgcccattttcaccatttaaagggtcctagaggaaggaataaagtattttaagagttgcttctcgccgggcacggtgactcacgcctgtaatcccagcactttgggaggaccaggcagatggatcccgaggtcaggagattgagaccagcctgaccaacaagtgaaaccctgtctctactaaaaatacaaaaattagccgggcgtggtggcatgtgcctgtaatcccagatactcaggaggctgaggcaggagacttgcttgaacccaggaggtggaggttgcagtgagccgagatggtgccactgcactccagcctgggcgcagagctagactctgtctcaaaaaaaaaaaaaaaaaaaagagttgcttctctttgcaaaaaactagtttatttaaaaatttaaaatagggttcctgaggacctgtgggcaatacctccagcgttttttttggaattgtgtcaggttcaagccattctcctgcctcagcctcccaagtagctgggattaaaggcgtgtgccaccatgcccagctgattttgtatttttagtagagatagcgtttcactgttggtcaggctggtcttcaactcctgacctcaggtgatccacctacctcaccttcccaaagtgctgtgattacaggcatgagccactgcacctggcctcaatttttgtatttttagtagagacggggtttcaatatgttggccaggctggtctcgaattcctgactacaggtgatccgcctgcctcagcctcccaaagtgctgaggtgtgagccaccgcgccaagccaggtgttctgtaatttggatattttacttactatagcattcagcttaaatttgtttggtttaattataattttatgttttcttgaattttacttatgtttttgaacaaaagtcctatgacaatgaacctgatttttaagagagtaaattgaactttgaggttttaaatttcctgtagatgcagtttaacttgaacttacaatgcttcaaataatggaaaaattaggatgtttatctttggtaaactctttttgtcttatctttcctataattttaaatgtacttagtacagaacccagaccatccatactcattaatttgttcattcagcagatatttagtaagcatctcctctgtgctaggtgctaggaataaaatgagtgaaatatgcaagcttccatagcctgagtactttgcttaccttgccagtgatgcttgtagtcacatgtgcgggacagtgcaatcacagctgcaaaaagtagaggtgacagaaaggcacagaacctccaagatttcccacggccttgtggtgtgaagcagtgtaacttccctgccaggtagaaggacgcaaaggccagaccagcaaatgcaactggaacaagaaaaacttttaagtggtttgtcttttaaaggaagctacctcattcatccccacataggaggctaggaagcatgagtatgtttttatttatttattttttgagacagtcttgctctgtcgcccaggctggagtgcagtggcaccatctcggctcactgcaacctccaccacccgggttcaagcgattctcctgccttagcctcccgagtagctgggactccatgtgtgtgccaccatgcccagctaatttttttatttttagtagagttgggatttcaccatgttggctagcctggtcttgaactcctggcctcaagtgacctgcatgccttggcctcccaattgctgggattacaggtatgagccaccacacccggccatgagggtgttttaatccttttttgtgtatacttatagtgtaagtcattgtgaaggaaagggaaacaaaaagaaaaatgaaggacttagtgccccaaagttaatgttttatctgagtatagttttcggtatactagctatatgtatcaacttgttgatgctttagtttcctcatctataaatgggactcataaatacaatagtccccacctcattggattattgtgagctataattaggtaagaaatgaaaatgcttcaaagtacctgacacatagaaactcttcgttaaaggtatttttattgctagtacaagattgcaggatctaggcaaataatataacaattaaatgtgcaaatctcatgaaggtaaactacctttctgttctgtaatatttacccaaatagtcaaggctcagacttgttaaactgtggagttactaaagaaggggggattttccaaattgtagaaacaagagtagtcagattttcccatccctactagctttctaggttaaattcaatgatgtgaaaacaagcatagggtagagtccatatgatattcatacaggaagaatgtccactggggaagctctttcggccctcattcaccacgtccttatcccctgtacacatcaagtcagaatgggctagcccatcagggaagcagcggtagaagaaatctgggcgtggcctggaagaaagcagcatggttggaacgtaaatcattaactccagaaattatttttcagttgtagcagacattaataatcctgttaactattggtcaaatagtgccccaggcaaaataaggtaactggcttagtatagtcaccacactaagagaaaagcctttcaaggtgagcatttaaattaggggaaaaacgcccattccagcacatgattactttttagggcaaacagcaaatgacactgcagcttcaggaggtgctcaagaggacactgaccgactgctgtggccgttggtgggaaatgctgttcaggcagaaaagagcccaggtgtcacctggaggactgaggtatggggaagggagtaagcgttgaatgacaaaagaaaaatcagagtgaagataaaggagaaaagaatgagaaagacgtgtggtggacaccattaacctctctgttctggtgggtaagggctgaggcagatgctggggtggttagctgttgtcacttacctccctacgatcagttttattgtgttggtaaagacgccattcagagccagggcaaggctggcagctgcaaagcaaagccattagttgaaaggatctgtctaggaggaaaggtatggtcatggcctcgttatgagagcagccgtgctgtttctgagatggatagaatccaaccaggcctgggcacaaaaataattagggtcctcagtgatcactcttttgtagccgagaacttttgtactaggccaaagacatttctgaggtacaaataacccagtgcatttaggcacagggctgcctgccgtgtagcctgcgtaaccaagtccctgcagtgctattttcctctcccgcggggatagagttcctttaggaatgcagaactcagtggcctccacacaggctcaccgtggctgaatcccacaacgacctcctaggttcccagcacgaagaaaccggcccgaaagggctagcgctcacccaggcaggcttgtctgctgtctcttgtgtctgccttcttgagaaatttggccaggaagatcagagacagtggagagagaaatgcaataacctgaatcagaatgtcagaggttaaaaacaatccaaaaaaaagccacactcgtgctcctacaggaaagagggatgtgacacagcaggactcactggagctaacataaggtctctgagtgcgcgtaaccgggcgccaggcagcgccaccagtgaacagcagcgcccgtgcggctcgggccccggtacctcaggctgaggcacagagcgcccgggaaaacgttgtctcagcccaaagaggctcggacaccctcctctctcaatcaggatcttaaacactcgagccctaggaggcggaacccagcgcacagcagcggagtgggcagtgggtccctacaaaggccgtctcggggtggaaaacgcacaggtgcccgcgggaagccgggtcatggggagggaggaaagacgatctttctccacgcacaaacatcggcttggtggggaaatactccgcctccacgtaggggttccggtagagccacatctcctccggctggatgagtctctggaacggggggagcagctccgtcaccctagaggggaacaaagaagcgcagagcaggtcgcctggcttcctccccgcttccccactgcccgacccgccgccccgtgccgcccgcctgcctgggaagcggggccgcccgggcccggccgtggatctttcttacaggaaggccgcgaacagcgcgagccgcacgcccacttcggccccaaaggccaccgccgccgccgccttccccatccggccgcgagctccgagcga

SEQ ID NO: 597 - DNA, 2241 bp, Homo sapiens
tcttcgttaaaggtatttttattgctagtacaagattgcaggatctaggcaaataatataacaattaaatgtgcaaatctcatgaaggtaaactacctttctgttctgtaatatttacccaaatagtcaaggctcagacttgttaaactgtggagttactaaagaaggggggattttccaaattgtagaaacaagagtagtcagattttcccatccctactagctttctaggttaaattcaatgatgtgaaaacaagcatagggtagagtccatatgatattcatacaggaagaatgtccactggggaagctctttcggccctcattcaccacgtccttatcccctgtacacatcaagtcagaatgggctagcccatcagggaagcagcggtagaagaaatctgggcgtggcctggaagaaagcagcatggttggaacgtaaatcattaactccagaaattatttttcagttgtagcagacattaataatcctgttaactattggtcaaatagtgccccaggcaaaataaggtaactggcttagtatagtcaccacactaagagaaaagcctttcaaggtgagcatttaaattaggggaaaaacgcccattccagcacatgattactttttagggcaaacagcaaatgacactgcagcttcaggaggtgctcaagaggacactgaccgactgctgtggccgttggtgggaaatgctgttcaggcagaaaagagcccaggtgtcacctggaggactgaggtatggggaagggagtaagcgttgaatgacaaaagaaaaatcagagtgaagataaaggagaaaagaatgagaaagacgtgtggtggacaccattaacctctctgttctggtgggtaagggctgaggcagatgctggggtggttagctgttgtcacttacctccctacgatcagttttattgtgttggtaaagacgccattcagagccagggcaaggctggcagctgcaaagcaaagccattagttgaaaggatctgtctaggaggaaaggtatggtcatggcctcgttatgagagcagccgtgctgtttctgagatggatagaatccaaccaggcctgggcacaaaaataattagggtcctcagtgatcactcttttgtagccgagaacttttgtactaggccaaagacatttctgaggtacaaataacccagtgcatttaggcacagggctgcctgccgtgtagcctgcgtaaccaagtccctgcagtgctattttcctctcccgcggggatagagttcctttaggaatgcagaactcagtggcctccacacaggctcaccgtggctgaatcccacaacgacctcctaggttcccagcacgaagaaaccggcccgaaagggctagcgctcacccaggcaggcttgtctgctgtctcttgtgtctgccttcttgagaaatttggccaggaagatcagagacagtggagagagaaatgcaataacctgaatcagaatgtcagaggttaaaaacaatccaaaaaaaagccacactcgtgctcctacaggaaagagggatgtgacacagcaggactcactggagctaacataaggtctctgagtgcgcgtaaccgggcgccaggcagcgccaccagtgaacagcagcgcccgtgcggctcgggccccggtacctcaggctgaggcacagagcgcccgggaaaacgttgtctcagcccaaagaggctcggacaccctcctctctcaatcaggatcttaaacactcgagccctaggaggcggaacccagcgcacagcagcggagtgggcagtgggtccctacaaaggccgtctcggggtggaaaacgcacaggtgcccgcgggaagccgggtcatggggagggaggaaagacgatctttctccacgcacaaacatcggcttggtggggaaatactccgcctccacgtaggggttccggtagagccacatctcctccggctggatgagtctctggaacggggggagcagctccgtcaccctagaggggaacaaagaagcgcagagcaggtcgcctggcttcctccccgcttccccactgcccgacccgccgccccgtgccgcccgcctgcctgggaagcggggccgcccgggcccggccgtggatctttcttacaggaaggccgcgaacagcgcgagccgcacgcccacttcggccccaaaggccaccgccgccgccgccttccccatccggccgcgagctccgagcga
